US007267965B2

(12) United States Patent
Otte et al.

(10) Patent No.: US 7,267,965 B2
(45) Date of Patent: Sep. 11, 2007

(54) MEANS AND METHODS FOR REGULATING GENE EXPRESSION

(75) Inventors: Arie P. Otte, Amersfoort (NL); Arthur L. Kruckeberg, Shoreline, WA (US); David P. E. Satijn, Nieuwegein (NL)

(73) Assignee: Chromagenics B.V., Leiden (NL)

( * ) Notice: Subject to any disclaimer, the term of this patent is extended or adjusted under 35 U.S.C. 154(b) by 116 days.

(21) Appl. No.: 11/012,546

(22) Filed: Dec. 14, 2004

(65) Prior Publication Data

US 2005/0214906 A1 Sep. 29, 2005

Related U.S. Application Data

(63) Continuation of application No. PCT/NL03/00410, filed on May 30, 2003.

(30) Foreign Application Priority Data

Jun. 14, 2002 (EP) ................................ 02077344

(51) Int. Cl.
  C12P 21/06 (2006.01)
  C12P 21/04 (2006.01)
  C12N 15/00 (2006.01)
  C12N 5/00 (2006.01)
  C12N 5/06 (2006.01)
  C12N 5/08 (2006.01)
  C12N 5/10 (2006.01)
  C12N 15/64 (2006.01)

(52) U.S. Cl. .................. 435/69.1; 435/70.1; 435/320.1; 435/325; 435/326; 435/358; 435/372.1; 435/369; 435/363; 435/364; 435/371

(58) Field of Classification Search ...................... None
  See application file for complete search history.

(56) References Cited

U.S. PATENT DOCUMENTS

| 5,610,053 | A | 3/1997 | Chung et al. |
| 5,773,695 | A | 6/1998 | Thompson et al. |
| 5,888,809 | A | 3/1999 | Allison |
| 6,395,549 | B1 | 5/2002 | Tuan et al. |
| 6,521,419 | B1 | 2/2003 | Koduri et al. |
| 6,586,205 | B1 | 7/2003 | Glucksmann et al. |
| 6,872,524 | B1 | 3/2005 | Otte |
| 2003/0138908 | A1 | 7/2003 | Koduri et al. |
| 2003/0166042 | A1 | 9/2003 | Glucksmann et al. |
| 2003/0199468 | A1 | 10/2003 | Otte et al. |
| 2005/0106609 | A1 | 5/2005 | Otte |

FOREIGN PATENT DOCUMENTS

| EP | 1 273 666 | 1/2003 |
| WO | WO96/04390 | 2/1996 |
| WO | WO97/27207 | 7/1997 |
| WO | WO98/11207 | 3/1998 |
| WO | WO98/49289 | 11/1998 |
| WO | WO 00/05393 | 2/2000 |
| WO | WO 00/09749 | 2/2000 |
| WO | WO 00/17337 | 3/2000 |
| WO | WO 00/23606 | 4/2000 |
| WO | WO 01/59117 | 8/2001 |
| WO | WO 01/59118 | 8/2001 |
| WO | WO 02/24930 A2 | 3/2002 |
| WO | WO 03/004704 | 1/2003 |
| WO | WO 2004/055215 A1 | 7/2004 |
| WO | WO 2004/056986 A2 | 7/2004 |

OTHER PUBLICATIONS

Van Der Vlag et al., "Transcriptional Repression Mediated by Polycomb Group Proteins and Other Chromatin-associated Repressors Is Selectively Blacked by Insulators," J. of Biological Chemistry, Jan. 7, 2000, pp. 697-704, vol. 275, No. 1.

Emery et al., "A chromatin insulator protects retrovirus vectors from chromosomal postion effects," Proceedings of the National Academy of Sciences of USA, Aug. 1, 2000, pp. 9150-9155, vol. 97, No. 16.

West et al., "Insulators: many functions, many mechanisms," Genes and Development, Feb. 1, 2002, pp. 271-288, vol. 16, No. 3.

Kwaks et al., "Identification of anti-repressor elements that confer high stable protein in production in mammalian cells," Nature Biotechnology, May 20, 2003, pp. 553-558, vol. 21, No. 5.

Pile et al., "GAGA Factor-dependent Transcription and Establishment of DNase Hypersensitivity Are Independent and Unrealated Events In Vivo," J. of Biological Chemisty, Jan. 14, 2000, pp. 1398-1404, vol. 275, No. 2.

Sigrist et al., "Chromatin Insulator Elements Black the Silencing of a Target Gene by the Drosophila Polycomb Response Element (PRE) but Allow trans Interactions Between PREs on Different Chromosomes," Genetics, Sep. 1997, pp. 209-211, vol. 147, No. 1.

Aranda et al., Definition of Transcriptional Pause Elements in Fission Yeast, Molecular and Cellular Biology, Feb. 1999, pp. 1251-1261, vol. 19, No. 2.

(Continued)

Primary Examiner—David Guzo
Assistant Examiner—Kimberly A. Makar
(74) Attorney, Agent, or Firm—TraskBritt

(57) ABSTRACT

The invention relates to means and methods for regulating gene expression and production of proteinaceous molecules. The invention provides a method for producing a proteinaceous molecule in a cell comprising selecting a cell for its suitability for producing the proteinaceous molecule, providing a nucleic acid encoding the proteinaceous molecule with a nucleic acid comprising a STAR (STabilizing Anti-Repression) sequence, expressing the resulting nucleic acid in the cell and collecting the proteinaceous molecule. Providing at least one STAR sequence to a nucleic acid encoding a proteinaceous molecule will enhance production (yield) of the proteinaceous molecule by a host cell, increase the proportion of host cells with acceptable expression levels, and/or increase stability of a gene expression level.

11 Claims, 22 Drawing Sheets

OTHER PUBLICATIONS

Auten et al., "Effect of Scaffold Attachment Region on Transgene Expression in Retrovirus Vector-Transduced Primary T cells and Macrophages," Human Gene Therapy, May 20, 1999, pp. 1389-1399, vol. 10, No. 8.

Burgess-Beusse et al., The insulation of genes from external enhancers and silencing chromatin, PNAS, Dec. 10, 2002, pp. 16433-16437, vol. 99, Suppl. 4.

Chan et al., p300-CBP proteins: HATs for transcriptional bridges and scaffolds, Journal of Cell Science, 2001, pp. 2363-2373, vol. 114.

Eggermont et al., Poly(A) signals and transcriptional pause sites combine to prevent interference between RNA polymerase II promoters, The EMBO Journal, 1993, pp. 2539-2548, vol. 12, No. 6.

Farrell et al., Conserved CTCF Insulator Elements Flank the Mouse and Human Beta-Globin Loci, Molecular and Cellular Biology, Jun. 2002, pp. 3820-3831, vol. 22, No. 11.

Glucksmann et al., Database accession No. AAH76193, Oct. 29, 2001.

Han et al., "Matrix attachment regions (MARs) enhance transformation frequency and transgene expression in poplar," Transgenic Research, 1997, pp. 415-420, vol. 6.

Johnson et al., Requirements for utilization of CREB binding protein by hypersensitive site two of the Beta-globin locus control region, Nucleic Acids Research 2002, pp. 1522-1530, vol. 30, No. 7.

Maniatis et al., Recognition Sequences of Repressor and Polymerase in the Operators of Bacteriophage Lambda, Cell, Jun. 1975, pp. 109-113, vol. 5.

Martinez-Balbas et al., The acetyltransferase activity of CBP stimulates transcription, The EMBO Journal, 1998, pp. 2886-2893, vol. 17, No. 10.

Mielke et al., "Stabilized, long-term expression of heterodimeric proteins from trieistronic mRNA," Gene, Aug. 22, 2000, pp. 1-8, vol. 254, No. 1-2.

Migliaccio et al., "Stable and unstable transgene integration sites in the human genome: extinction of the Green Fluorescent Protein transgene in K562 cells," Gene, Oct. 3, 2000, pp. 197-214, vol. 256, No. 1-2.

Reik et al., Biotechnologies and therapeutics: Chromatin as a target, Current Opinion in Genetics & Development, 2002, pp. 233-242, vol. 12.

Seum et al., A GALA-HP1 fusion protein targeted near heterochromatin promotes gene silencing, Chromosoma, 2000, pp. 453-459, vol. 109.

Bell et al., Insulators and Boundaries: Versatile Regulatory Elements in the Eukaryotic Genome, Science, pp. 447-450, vol. 291, No. 5503, 2001.

Chung et al., A 5' Element of the Chicken Beta-Globin Domain Serves as an Insulator in Human Erythroid Cells and Protects against Position Effect in Drosophila, Aug. 13, 1993, Cell, pp. 505-514, vol. 74.

Database EMBL 'Online!, Jul 8, 1992, *H. sapiens* HOX4B gene upstream sequence XP00248163 retrieved from EBI, Database accession No. X67079, Abstract.

Kellum et al., A Group of scs Elements Function as Domain Boundaries in an Enhancer-Blocking Assay, Molecular and Cellular Biology, May 1992, pp. 2424-2431, vol. 12, No. 5.

Database EMBL 'Online! Aug. 4, 1999, "*Homo sapiens* chromosome 19 clone CTD-2540B15, complete sequence," XP002359985 retrieved from EBI accession No. EM_PRO:AC008738, database accession No. AC008738 for SEQ ID No. 7.

Database EMBL 'Online! Feb. 3, 2004, "Sequence 33099 from Patent W002068579," XP002359986 retrieved from EBI accesssion No. EM_PRO:CQ747165, database accession No. CQ747165 for SEQ ID No. 9.

Database EMBL 'Online! Sep. 24, 2000, "*Homo sapiens* chomosome 4 clone RP11-680118, working draft sequence, 25 unordered pieces," XP002359987 retrieved from EBI accession No. EM_PRO:AC080087, database accession No. AC080087 for SEQ ID No. 9.

Database EMBL 'Online! Dec. 15, 1999, "*Homo sapiens* BAC clone RP11-572N21 from 2, complete sequence," XP002359988 retrieved from EBI accession No. EM_PRO:AC018470, database accession No. AC018470 for SEQ ID No. 17.

Database EMBL 'Online! Dec. 23, 1999, "Human DNA sequence from clone RP11-54H19 on chromosome I Contains the 3' end of the LMNA gene for lamin A/C the gene for novel protein similar to semaphorins (FLJ12287), a novel gene (KIAA0446), the PMF1 gene for polyamine-modulated factor 1, the BGLAP gene for bone gamma-carboxyglutamate (gla) p," XP002359989, retrieved from EBI accession No. EM_PRO:AL135927, database accession No. AL135927 for SEQ ID No. 27.

Database EMBL 'Online! Apr. 26, 2001, "RST28606 Athersys RAGE Library *Homo sapiens* cDNA, MRNA sequence," XP002359990 retrieved from EBI accession No. EM_PRO:BG209092, database accession No. BG209092 for SEQ ID No. 40.

Database EMBL 'Online! Sep. 29, 1999, "*Homo sapiens* genomic DNA, chromosome 22q11.2, Cat Eye Syndrome region, clone:N64E9," XP002359991, retrieved from EBI accession No. EM_PRO:AP000526, database accession No. AP000526 for SEQ ID No. 40.

Database EMBL 'Online! Oct. 28, 1998, "*Homo sapiens* neurexin III-alpha gene, partial cds," XP002359992, retrieved from EBI accession No. EM_PRO:AF099810, database accession No. AF099810 for SEQ ID No. 43.

Database EMBL 'Online! Jan. 25, 2001, "QV2-NN0045-081200-535-c10 NN0045 *Homo sapiens* cDNA, mRNA sequence." XP002359993, retrieved from EBI accession No. EM_PRO:BF960930, database accession No. BF960930 for SEQ ID No. 43.

Database EMBL 'Online! Sep. 29, 1999, *Homo sapiens* genomic DNA, chromosome 22q11.2, Cat Eye Syndrome region, clone:N14H11, XP002359994, retrieved from EBI accession No. EM_PRO:AP000525, database accession No. AP000525 for SEQ ID No. 44.

Database EMBL 'Online! Mar. 19, 1998, CIT-HSP-2172C8.TF CIT-HSP *Homo sapiens* genomic clone 2172C8, genomic survey sequence, XP002359995, retrieved from EBI accession No. EM_PRO:B92131, database accession No. B92131 for SEQ ID No. 44.

Database EMBL 'Online! Sep. 29, 1999, "*Homo sapiens* genomic DNA, chromosome 22q11.2, Cat Eye Syndrome region, clone:c91G6," XP002359996 retrieved from EBI accession No. EM_PRO:AP000528, database accession No. AP000528 for SEQ ID No. 45.

Database EMBL 'Online! Mar. 15, 1999, "*Homo sapiens* chromosome UNK clone CTA-435J10, working draft sequence, 1 unordered pieces," XP002359997, retrieved from EBI accession No. EM_PRO:AC007044, database accession No. AC007044 for SEQ ID No. 61.

Vector for isolating STAR elements

Vector for testing STAR activity

CHO cells, CMV promoter, SEAP, linear

STAR finemapping
(SEQ ID NOS: 10 and 27)

U-2 OS cells, SV40 promoter, luciferase, circular

U-2 OS cells, Tet-Off promoter, luciferase, circular

FIG. 9
STAR element orientation
A. pSelect vector with cloned STAR element:
B. pSDH vector, STARs in native orientation:
C. pSDH vector, STARs in opposite orientation:
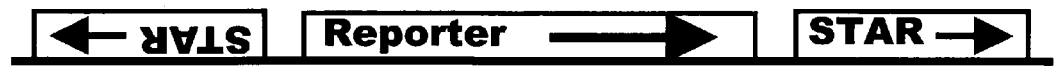

Directionality of STAR function
(for SEQ ID NO:66)

STAR copy number dependency

STAR copy number dependency

Schematic diagram of Enhancer and Enhancer-blocking Assays

Enhancer-blocking assay

Enhancer assay

STAR18 sequence and function is conserved between mouse and human

Schematic Diagram of STAR Element Bioinformatic Analysis

Classification of STARs by Discriminant Analysis with Oligo and Dyad Models

RT-PCR assay of Arabidopsis STAR strength

The effect of STAR7 (SEQ ID NO:7) on GFP expression in CHO cells

The effect of STAR7 (SEQ ID NO:7) on GFP expression in 293 cells

MEANS AND METHODS FOR REGULATING GENE EXPRESSION

CROSS-REFERENCE TO RELATED APPLICATIONS

This is a continuation of International Patent Application No. PCT/NL03/00410, filed May 30, 2003, published in English as International Patent Publication No. WO 03/106674 on Dec. 24, 2003, which claims the benefit under 35 U.S.C. § 119 of European Patent Application No. EP 02077344.6, filed Jun. 14, 2002, the entirety of both are hereby incorporated by reference.

STATEMENT ACCORDING TO 37 C.F.R § 1.52(e)(5)—SEQUENCE LISTING SUBMITTED ON COMPACT DISC

Pursuant to 37 C.F.R. § 1.52(e)(1)(iii), a compact disc containing an electronic version of the Sequence Listing has been submitted concomitant with this application, the contents of which are hereby incorporated by reference. The compact disc contains the file "P6055PC00.txt" which is 498 KB, and created on Nov. 29, 2004. A second compact disk is submitted and is an identical copy of the first compact disc (labeled, "copy 1" and "copy 2," respectively).

TECHNICAL FIELD

The invention relates to the fields of medicine and cellular biology. More specifically, the invention relates to means and methods for regulating gene expression, and production of proteinaceous molecules.

BACKGROUND OF THE INVENTION

Polypeptide production at industrial scale currently provides many biologically active polypeptides for a variety of uses, including diagnostic and therapeutic pharmaceuticals, industrial catalysts and nourishment. Polypeptides are produced in a variety of host systems, including transgenic animals and plants, microbes, and cultured mammalian cells. In most cases, the host system is modified by recombinant DNA techniques, for instance resulting in introduction into the host cell of a transgene which encodes a polypeptide of interest. Such a transgene typically includes elements that influence the transcription, translation, and/or processing of the transgene's polypeptide coding sequence. A recombinant host is then identified and isolated which has a suitable yield of a polypeptide of interest, and the cell population of this recombinant host is increased to an extent that it can produce the required amount of polypeptide.

The choice of the host system depends on a number of factors including: (1) the nature and intended use of a polypeptide, and (2) the cost of production. For production of biopharmaceuticals, e.g., therapeutic proteins such as hormones, cytokines, and antibodies, the host system of choice is usually cultured mammalian cells. Considerations with respect to product use and production cost with host cells will be discussed below.

(1) For in vivo therapeutic use, a therapeutic protein must not only have the correct biological activity to alter the course of a disease. It must also do no harm. Most therapeutic proteins are exported from the cell by the secretory pathway. Secreted proteins are modified by a series of post-translational events, including glycosylation, disulfide bond formation, and proteolytic processing. The post-translational modification systems vary among different species and cell types in their detailed mechanisms of action. As a result, the same polypeptide chain can be detectably different when it is produced in different host cells. These differences can be analytical, such as differences in physical properties such as molecular mass, net electrical charge, carbohydrate composition, or structure. The differences can also be functional, affecting for instance the biological activity of the protein itself (catalytic activity, ligand binding characteristics, etc.), and/or its in vivo properties (immunogenicity, biological half life, biodistribution, etc.). Functional differences can, therefore, affect both function and possible side effect(s) of a therapeutic protein. Host cell lines that produce proteins with low efficacy are not suitable for commercial exploitation. Furthermore, host cells which produce modified protein that involves significant side effects in a patient should not be used. These factors are becoming increasingly important considerations during selection of a host cell line for production of a therapeutic protein.

(2) Therapeutic protein production in host cells is an intrinsically costly process. Current methods for industrial production of such proteins often perform poorly, resulting in products that are prohibitively expensive. Poor performance can be due to limitations of protein expression systems and host cell lines currently in use. These limitations mostly have a few specific causes, including (a) failure to identify and isolate recombinant host cell lines that have suitable productivity of proteins (poor predictability), (b) silencing, during the industrial production cycle, of the transgenes that encode proteins (poor stability), and (c) low or incorrect post-translational processing and secretory capacity of the host cell line. These limitations will be considered separately below.

(a) Conventional methods furnish only low frequencies of recombinant host cells that have suitable yields of proteins. Identifying and isolating these rare recombinant cell lines is a laborious and expensive process. The poor predictability of conventional methods means that often a recombinant host cell line is selected for production that has sub-optimal productivity characteristics, simply because a superior recombinant cell line was not identified and isolated during the selection process.

(b) Transgenes are often subject to silencing during cultivation of recombinant host cells. Silencing acts by suppressing transcription of a transgene. Detailed mechanisms of silencing are still not known, and different conventional methods are prone to different kinds of silencing phenomena. With one phenomenon, an individual transgene is silenced by formation of transcriptionally refractory heterochromatin at the transgenic locus. Heterochromatin formation is influenced by the position of genomic integration of a transgene ("position effects" (Boivin & Dura, 1998)). Transgene integration occurs more or less at random. Since most of the genome is heterochromatin, most transgene loci are prone to silencing due to position effects.

A second transgene-silencing phenomenon can occur when two or more copies of a transgene are integrated into a genome during construction of a recombinant cell line. Formation of tandem transgene repeats often occurs during the initial integration step. Furthermore, in order to increase product yield, many recombinant host cell lines are engineered after the integration step to amplify the copy number of a transgene, which also results in tandem transgene repeats (Kaufman, 1990). Tandem repeats and other configurations of multiple transgene copies are particularly prone to silencing ("repeat-induced gene silencing" (Garrick et al., 1998)).

In case that a genome contains multiple copies of a transgene, the yield can also decline via another phenomenon than transcriptional silencing. The number of copies of the transgene can decline during cultivation of a recombinant host cell line. The productivity of such cell lines at the time of selection for use is correlated with a transgene copy number, and consequently as copies of a transgene are lost, the yield declines (Kaufman, 1990).

(c) Different cell types in a mammalian organism have different capacities for post-translational modification and secretion of proteins. The functions of some cell types include production of large quantities of secreted proteins; examples include lymphocytes (producing immunoglobulins), hepatocytes (producing serum proteins), and fibroblasts (producing extracellular matrix proteins). These cell types are favorable sources for deriving host cell lines for production of secreted heterologous proteins. More favorable is the use of a cell line whose progenitor organismal cell type secretes a protein or class of proteins of interest. For example, it is particularly favorable to express recombinant monoclonal antibodies in lymphocytes (or host cells derived from lymphocytes), erythropoietin in hepatocytes (or host cells derived from hepatocytes), and blood clotting factors (e.g., Factor VIII and van Willebrand's factor) in endothelial cells (or host cells derived from endothelial cells).

The use of specific cell types (or cell lines derived therefrom) for production of their affiliated proteins is favorable because such specific cell types will carry out proper post-translational modifications of produced proteins. However, specific cell types often do not have high secretory capacities. For example, cells of the central nervous system, such as neurons, have low intrinsic protein secretion capacities. These cells do secrete proteins, however, including neurotrophins. Neurotrophins regulate the fate and shape of neuronal cells during fetal and juvenile development. Moreover, they influence patterns of neuronal degeneration and regeneration in adults (Bibel & Barde, 2000). Production of neurotrophins for therapeutic applications has considerable biopharmaceutical value (e.g., Axokine™, recombinant ciliary neurotrophic factor from Regeneron). In order to produce heterologous neurotrophins with post-translational modifications (and hence functional properties) that match the naturally-occurring proteins, expression in host cells derived from the central nervous system is favorable. However, production of polypeptides such as neurotrophins in host cell lines such as those derived from neural tissue is inefficient using conventional methods. The predictability of identifying high-expressor isolates from these types of cell lines is often poor; the yield of proteins from such cell lines is generally low, and production levels are characteristically unstable.

Another drawback to a use of specific host cells for production of affiliated proteins is that it is usually difficult to isolate cell lines with favorable biotechnological characteristics. These characteristics for instance include the mode and rate of growth, and the ease of introduction of a transgene. Consequently, various general host cell lines have been established. Examples of these include CHO cells from Chinese hamster ovary (ATCC (American Type Culture Collection) CCL-61), BHK cells from baby hamster kidney (ATCC CCL-10), and Vero cells from African green monkey kidney (ATCC CCL-81). These "general purpose" host cell lines are widely used for production of a number of heterologous proteins. A disadvantage of general purpose cell lines is that the post-translational modifications of heterologous proteins produced by them often differ from the post-translational modifications of the naturally occurring proteins. These differences can have functional consequences resulting in side effects, as discussed above.

Table 1 lists a number of proteins that are currently in use or under development for biopharmaceutical applications. It also lists the tissue or cell type in which each protein is normally produced in the human body. These 24 proteins (or protein classes) come from a wide range of cells and tissue, ranging from highly secretory cells (hepatocytes, endothelial cells) to cells with low secretory capacity (e.g., neural tissue). Currently, neither general-purpose host cells nor specific host cells have qualities that enable optimal expression of the broad spectrum of biopharmaceutically important secreted proteins.

Hence, protein production by conventional host cell lines involves a lot of disadvantages and complications, for instance with respect to yield and post-translational modifications. There is a need in the art for improved protein production in recombinant host cell lines.

SUMMARY OF THE INVENTION

The present invention provides a method for producing a proteinaceous molecule in a cell comprising selecting a cell for its suitability for producing the proteinaceous molecule, providing a nucleic acid encoding the proteinaceous molecule with a nucleic acid comprising a STAR (STabilizing Anti-Repression) sequence, expressing the resulting nucleic acid in the cell and collecting the proteinaceous molecule.

The STAR sequence has to be operably linked to the nucleic acid encoding the proteinaceous molecule in order to be effective. In one embodiment of the invention, one STAR element is used. Preferably however, more than one STAR element is used. In a particularly preferred embodiment, the nucleic acid encoding the proteinaceous molecule is provided with two STAR sequences; one STAR sequence at the 5' side of the coding sequence of the nucleic acid and one STAR sequence at the 3' side of the coding sequence of the nucleic acid.

Description of STAR Elements

New transcription regulatory elements were disclosed by the present inventors, which are named STAR sequences (See EP 01202581.3). STAR sequences are nucleic acid sequences that comprise a capacity to influence transcription of genes in cis. Typically, although not necessarily, the STAR sequences do not code by themselves for a functional protein.

A STAR sequence has a gene transcription modulating quality in at least one type of cell. A STAR sequence is capable of enhancing gene transcription resulting in a higher yield, increasing the proportion of transgene-comprising host cells with acceptable expression levels, and/or increasing stability of transgenes in recombinant cell lines.

In EP 01202581.3 a method of detecting, and optionally selecting, a STAR sequence is provided, comprising providing a transcription system with a variety of a fragment-comprising vectors, the vectors comprising i) an element with a gene-transcription repressing quality, and ii) a promoter directing transcription of a reporter gene, the method further comprising performing a selection step in the transcription system in order to identify the STAR sequence. In a preferred embodiment, the fragments are located between i) the element with a gene-transcription repressing quality, and ii) the promoter directing transcription of the reporter gene. RNA polymerase initiates the transcription process after binding to a specific sequence, called the promoter, that signals where RNA synthesis should begin. A STAR sequence can enhance transcription from the promoter in cis, in a given cell type and/or a given promoter.

Methods disclosed in EP 01202581.3 have been used to isolate STAR elements from the human genome. Isolated human STAR elements have been placed in DNA vectors so as to flank transgene expression units, and the vectors have subsequently been integrated into host cell genomes. Transgene expression in these recombinant host cells has been compared to expression in similar host cells in which the expression units are not flanked by STAR elements. The results show that STAR elements have at least one of three consequences for production of (heterologous) proteinaceous molecule (also referred to as (heterologous) protein): (1) they increase the predictability of identifying host cell lines that express a proteinaceous molecule at industrially acceptable levels; (2) they result in host cell lines with increased protein yields; and/or (3) they result in host cell lines that exhibit more stable protein production during prolonged cultivation. Each of these attributes is discussed in more detail below:

(1) Increased predictability: Integration of transgene expression units can occur at random positions throughout the host cell genome. However, much of the genome is transcriptionally silent heterochromatin. When the expression units include STAR elements flanking the transgene, the position of integration has a reduced effect on expression. The STAR elements impair the ability of adjacent heterochromatin to silence the transgene. Consequently, the proportion of transgene-containing host cells with acceptable expression levels is increased.

(2) Yield: The levels of protein expression in primary populations of recombinant host cells, directly after transgene integration, have been surveyed. The expression level of individuals in the populations varies. However, when the transgenes are protected by STAR elements, the variability is reduced. This reduced variability is most conspicuous in that fewer clones are recovered that have low levels of expression. Furthermore, the populations with STAR elements commonly have individuals with strikingly high expression. These high-yielding individuals are favorable for production of proteinaceous molecules.

(3) Increased stability: STAR elements increase the stability of transgenes in recombinant host cell lines by ensuring that the transgenes are not transcriptionally silenced during prolonged cultivation. Comparative trials show that, under conditions in which transgenes that are not protected by STAR elements are progressively silenced (5 to 25 passages in cultivation), STAR element-protected transgenes continue to be expressed at high levels. This is an advantage during industrial production of proteinaceous molecules, during which cell cultivation continues for prolonged periods, from a few weeks to many months.

Hence, a STAR sequence can enhance expression of a heterologous proteinaceous molecule. In addition, a STAR sequence can enhance expression of a naturally produced proteinaceous molecule.

Transcription can be influenced through a direct effect of the STAR sequence (or the protein(s) binding to it) on the transcription of a particular promoter. Transcription can however, also be influenced by an indirect effect, for instance because the STAR sequence affects the function of one or more other regulatory elements. A STAR sequence can also comprise a stable gene transcription quality. Frequently, expression levels drop dramatically with increasing numbers of cell divisions. With the methods disclosed in EP 01202581.3 it is possible to detect and optionally select a DNA sequence that is capable of at least in part preventing the dramatic drop in transcription levels with increasing numbers of cell divisions. Strikingly, fragments comprising a STAR sequence can be detected and optionally selected with a method EP 01202581.3, in spite of the fact that the method does not necessarily measure long term stability of transcription.

A STAR sequence is suitable for enhancing the level of transcription of a gene of interest in a host cell. If, together with a gene of interest, a STAR sequence is also introduced into host cells, more clones can be detected that express more than a certain amount of the gene of interest. As used herein, such host cells are termed "host cells with acceptable expression levels."

Furthermore, if, together with a gene of interest, a STAR sequence is also introduced into host cells, a higher yield of produced proteinaceous molecules can be obtained, while gene expression level is also more stable than in the absence of such STAR sequences. Preferably, a STAR sequence derived from a plant and/or vertebrate is used. More preferably a human STAR sequence is used.

Sequences comprising a STAR sequence can be found by using a functional assay, as described above. However, once a collection of such sequences has been identified, bioinformatics can be used to find other STAR sequences. Several methods are available in the art to extract sequence identifiers from a family of DNA sequences sharing a certain common feature. Such sequence identifiers can subsequently be used to identify sequences that share one or more identifiers. Sequences sharing such one or more identifiers are likely to be a member of the same family of sequences, i.e., are likely to share the common feature of the family. By the present inventors a large number of sequences comprising STAR activity (so-called STAR sequences) were used to obtain sequence identifiers (patterns) which are characteristic for sequences comprising STAR activity. These patterns can be used to determine whether a test sequence is likely to contain STAR activity. A method for detecting the presence of a STAR sequence within a nucleic acid sequence of about 50-5000 base pairs is thus provided, comprising determining the frequency of occurrence in the sequence of at least one sequence pattern and determining that the frequency of occurrence is representative of the frequency of occurrence of at least one sequence pattern in at least one sequence comprising a STAR sequence. In principle any method is suited for determining whether a sequence pattern is representative of a STAR sequence. Many different methods are available in the art. Preferably, the step of determining that the occurrence is representative of the frequency of occurrence of at least one sequence pattern in at least one sequence comprising a STAR sequence comprises, determining that the frequency of occurrence of at least one sequence pattern significantly differs between at least one STAR sequence and at least one control sequence. In principle any significant difference is discriminative for the presence of a STAR sequence. However, in a particularly preferred embodiment, the frequency of occurrence of at least one sequence pattern is significantly higher in at least one sequence comprising a STAR sequence compared to at least one control sequence.

A considerable number of sequences comprising a STAR sequence have been identified by the present inventors. It is possible to use these sequences to test how efficient a pattern is in discriminating between a control sequence and a sequence comprising a STAR sequence. Using so-called discriminant analysis it is possible to determine on the basis of any set of STAR sequences in a species, the most optimal discriminative sequence patterns or combination thereof.

Thus, preferably, at least one of the patterns is selected on the basis of optimal discrimination between at least one sequence comprising a STAR sequence and a control sequence.

In a preferred embodiment, the frequency of occurrence of a sequence pattern in a test nucleic acid is compared with the frequency of occurrence in a sequence known to contain a STAR sequence. In this case, a pattern is considered representative for a sequence comprising a STAR sequence if the frequencies of occurrence are similar. In a preferred embodiment, another criterion is used. The frequency of occurrence of a pattern in a sequence comprising a STAR sequence is compared to the frequency of occurrence of the pattern in a control sequence. By comparing the two frequencies it is possible to determine for each pattern thus analyzed, whether the frequency in the sequence comprising the STAR sequence is significantly different from the frequency in the control sequence. In this embodiment, a sequence pattern is considered to be representative of a sequence comprising a STAR sequence, if the frequency of occurrence of the pattern in at least one sequence comprising a STAR sequence is significantly different from the frequency of occurrence of the same pattern in a control sequence. By using larger numbers of sequences comprising a STAR sequence the number of patterns for which a statistical difference can be established increases, thus enlarging the number of patterns for which the frequency of occurrence is representative for a sequence comprising a STAR sequence. Preferably, the frequency of occurrence is representative of the frequency of occurrence of at least one sequence pattern in at least two sequences comprising a STAR sequence; more preferably, in at least five sequences comprising a STAR sequence; and, even more preferably, in at least ten sequences comprising a STAR sequence. More preferably, the frequency of occurrence is representative of the frequency of occurrence of at least one sequence pattern in at least 20 sequences comprising a STAR sequence. In a particularly preferred embodiment, the frequency of occurrence is representative of the frequency of occurrence of at least one sequence pattern in at least 50 sequences comprising a STAR.

The patterns that are indicative for a sequence comprising a STAR sequence are also dependent on the type of control nucleic acid used. The type of control sequence used is preferably selected on the basis of the sequence in which the presence of a STAR sequence is to be detected. In a preferred embodiment, the control sequence comprises a random sequence comprising a similar AT/CG content as at least one sequence comprising a STAR sequence. In another preferred embodiment, the control sequence is derived from the same species as the sequence comprising the STAR sequence. For instance, if a test sequence is scrutinized for the presence of a STAR sequence, active in a plant cell, then preferably the control sequence is also derived from a plant cell. Similarly, for testing for STAR activity in a human cell, the control nucleic acid is preferably also derived from a human genome. In a preferred embodiment, the control sequence comprises between 50% and 150% of the bases of at least one sequence comprising a STAR sequence. In a particularly preferred embodiment, the control sequence comprises between 90% and 110% of the bases of at least one sequence comprising a STAR sequence. More preferably, between 95% and 105%.

A pattern can comprise any number of bases larger than two. Preferably, at least one sequence pattern comprises at least five, more preferably at least six, bases. In another embodiment, at least one sequence pattern comprises at least eight bases. In a preferred embodiment, the at least one sequence pattern comprises a pattern listed in Table 6 and/or Table 7. A pattern may consist of a consecutive list of bases. However, the pattern may also comprise bases that are interrupted one or more times by a number of bases that are not or only partly discriminative. A partly discriminative base is, for instance, indicated as a purine.

Preferably, the presence of STAR activity is verified using a functional assay. Several methods are presented herein to determine whether a sequence comprises STAR activity. STAR activity is confirmed if the sequence is capable of performing at least one of the following functions: (i) at least in part inhibiting the effect of sequence comprising a gene transcription repressing element of the invention, (ii) at least in part blocking chromatin-associated repression, (iii) at least in part blocking activity of an enhancer, (iv) conferring upon an operably linked nucleic acid encoding a transcription unit compared to the same nucleic acid alone, (iv-a) a higher predictability of transcription, (iv-b) a higher transcription, and/or (iv-c) a higher stability of transcription over time.

The large number of sequences comprising STAR activity identified by the present inventors open up a wide variety of possibilities to generate and identify sequences comprising the same activity in kind not necessarily in amount. For instance, it is well within the reach of a skilled person to alter the sequences identified in the present invention and test the altered sequence for STAR activity. Such altered sequences are, therefore, also part of the present invention. Alteration can include deletion, insertion and mutation of one or more bases in the sequences.

Sequences comprising STAR activity were identified in stretches of 400 bases. However, it is expected that not all of these 400 bases are required to retain STAR activity. Methods to delimit the sequences that confer a certain property to a fragment of between 400 and 5000 bases are well known. The minimal sequence length of a fragment comprising STAR activity is estimated to be about 50 bases.

Table 6 (SEQ ID NOS:177-342) and Table 7 (SEQ ID NOS:343-1072) list patterns of six bases that have been found to be over represented in nucleic acid molecules comprising STAR activity. This over representation is considered to be representative for a STAR sequence. The tables were generated for a family of 65 STAR sequences (SEQ ID NOS:1-65). Similar tables can be generated starting from a different set of STAR sequences, or from a smaller or larger set of STAR sequences. A pattern is representative for a STAR sequence if it is over represented in the STAR sequence compared to a sequence not comprising a STAR element. This can be a random sequence. However, to exclude a non relevant bias, the sequence comprising a STAR sequence is preferably compared to a genome or a significant part thereof. Preferably, a genome of a vertebrate or plant, more preferably, a human genome. A significant part of a genome is, for instance, a chromosome. Preferably the sequence comprising a STAR sequence and the control sequence are derived from nucleic acid of the same species.

The more STAR sequences are used for the determination of the frequency of occurrence of sequence patterns, the more representative for STARs the patterns are that are over- or under-represented. Considering that many of the functional features that can be expressed by nucleic acids are mediated by proteinaceous molecules binding to them, it is preferred that the representative pattern is over-represented in the STAR sequences. Such over-represented pattern can be part of a binding site for such a proteinaceous molecule. Preferably, the frequency of occurrence is representative of the frequency of occurrence of at least one sequence pattern in at least two sequences comprising a STAR sequence; more preferably, in at least five sequences comprising a STAR sequence; and, even more preferably, in at least ten sequences comprising a STAR sequence. More preferably, the frequency of occurrence is representative of the frequency of occurrence of at least one sequence pattern in at least 20 sequences comprising a STAR sequence. In a particularly preferred embodiment, the frequency of occurrence is representative of the frequency of occurrence of at least one sequence pattern in at least 50 sequences comprising a STAR. Preferably, the sequences comprising a STAR sequence comprises at least one of the sequences depicted in the sequences comprising STAR1-STAR65 (SEQ ID NOS: 1-65), sequences comprising STAR66 and testing set (SEQ ID NOS:66-84), and sequences comprising *Arabidopsis* STAR A1-A35 (SEQ ID NOS:85-119) (hereinafter SEQ ID NOS:1-119).

STAR activity is a feature shared by the sequences listed in SEQ ID NOS:1-119. However, this does not mean that they must all share the same identifier sequence. It is very well possible that different identifiers exist. Identifiers may confer this common feature onto a fragment containing it, though this is not necessarily so.

By using more sequences comprising STAR activity for determining the frequency of occurrence of a sequence pattern or patterns, it is possible to select patterns that are more often than others present or absent in such a STAR sequence. In this way it is possible to find patterns that are very frequently over- or under-represented in STAR sequences. Frequently, over- or under-represented patterns are more likely to identify candidate STAR sequences in test sets. Another way of using a set of over- or under-represented patterns is to determine which pattern or combination of patterns is best suited to identify a STAR in a sequence. Using so-called discriminative statistics, we have identified a set of patterns that performs best in identifying a sequence comprising a STAR element. In a preferred embodiment, at least one of the sequence patterns for detecting a STAR sequence comprises a sequence pattern GGACCC (SEQ ID NO:464), CCCTGC (SEQ ID NO:816), AAGCCC (SEQ ID NO:270), CCCCCA (SEQ ID NO:298) and/or AGCACC (SEQ ID NO:336). In another embodiment, at least one of the sequence patterns for detecting a STAR sequence comprises a sequence pattern CCCN{16}AGC (SEQ ID NO:415), GGCN{9}GAC (SEQ ID NO:536), CACN{13}AGG (SEQ ID NO:761), and/or CTGN{4}GCC (SEQ ID NO:839).

A list of STAR sequences can also be used to determine one or more consensus sequences therein. The invention, therefore, also provides a consensus sequence for a STAR element. This consensus sequence can of course be used to identify candidate STAR elements in a test sequence.

Moreover, once a sequence comprising a STAR element has been identified in a vertebrate it can be used by means of sequence homology to identify sequences comprising a STAR element in other species belonging to vertebrate. Preferably a mammalian STAR sequence is used to screen for STAR sequences in other mammalian species. Similarly, once a STAR sequence has been identified in a plant species, it can be used to screen for homologous sequences with similar function in other plant species. The invention in one aspect provides a STAR sequence obtainable by a method according to the invention. Further provided is a collection of STAR sequences. Preferably, the STAR sequence is a vertebrate or plant STAR sequence. More preferably, the STAR sequence is a mammalian STAR sequence or an angiosperm (monocot, such as rice or dicot, such as *Arabidopsis*). More preferably, the STAR sequence is a primate and/or human STAR sequence.

A list of sequences comprising STAR activity can be used to determine whether a test sequence comprises a STAR element. There are, as mentioned above, many different methods for using such a list for this purpose. In a preferred embodiment, the invention provides a method for determining whether a nucleic acid sequence of about 50-5000 base pairs comprises a STAR sequence, the method comprising: generating a first table of sequence patterns comprising the frequency of occurrence of the patterns in a collection of STAR sequences of the invention; generating a second table of the patterns comprising the frequency of occurrence of the patterns in at least one reference sequence; selecting at least one pattern of which the frequency of occurrence differs between the two tables; determining, within the nucleic acid sequence of about 50-5000 base pairs, the frequency of occurrence of at least one of the selected patterns; and determining whether the occurrence in the test nucleic acid is representative of the occurrence of the selected pattern in the collection of STAR sequences. Alternatively, determining comprises determining whether the frequency of occurrence in the test nucleic acid is representative of the frequency occurrence of the selected pattern in the collection of STAR sequences. Preferably, the method further comprises determining whether the candidate STAR comprises a gene transcription modulating quality using a method of the invention. Preferably, the collection of STARS comprises sequence as depicted in SEQ ID NOS: 1-119. In another aspect, the invention provides an isolated and/or recombinant nucleic acid sequence comprising a STAR sequence obtainable by a method of the invention.

As mentioned above, a STAR sequence can exert its activity in a directional way, i.e., more to one side of the fragment containing it than to the other. Moreover, STAR activity can be amplified in amount by multiplying the number of STAR elements. The latter suggests that a STAR element may comprise one or more elements comprising STAR activity. Another way of identifying a sequence capable of conferring STAR activity on a fragment containing it comprises selecting from a vertebrate or plant sequence, a sequence comprising STAR activity and identifying whether the selected sequence and sequences flanking the selected sequence are conserved in another species. Such conserved flanking sequences are likely to be functional sequences. In one aspect, the invention, therefore, provides a method for identifying a sequence comprising a STAR element comprising selecting a sequence of about 50 to 5000 base pairs from a vertebrate or plant species comprising a STAR element and identifying whether sequences flanking the selected sequence in the species are conserved in at least one other species. The invention, therefore, further provides a method for detecting the presence of a STAR sequence within a nucleic acid sequence of about 50-5000 base pairs, comprising identifying a sequence comprising a STAR sequence in a part of a chromosome of a cell of a species and detecting significant homology between the sequence and a sequence of a chromosome of a different species. Preferably, the species comprises a plant or vertebrate species, ideally a mammalian species. The invention also provides a method for detecting the presence of a STAR element within a nucleic acid sequence of about 50-5000 base pairs of a vertebrate or plant species, comprising identifying whether a flanking sequence of the nucleic acid sequence is conserved in at least one other species.

It is important to note that methods of the invention for detecting the presence of a sequence comprising a STAR sequence using bioinformatical information are iterative in nature. The more sequences comprising a STAR sequence are identified with a method of the invention, the more patterns are found to be discriminative between a sequence comprising a STAR sequence and a control sequence. Using these newly found discriminative patterns, more sequences comprising a STAR sequence can be identified, which, in turn, enlarges the set of patterns that can discriminate and so on. This iterative aspect is an important aspect of methods provided in the present invention.

BRIEF DESCRIPTION OF THE DRAWINGS

FIG. 9 is a schematic diagram of the orientation of STAR elements as they are cloned in the pSelect vector (panel A), as they are cloned into pSDH vectors to preserve their native orientation (panel B), and as they are cloned into pSDH vector in the opposite orientation (panel C).

DETAILED DESCRIPTION OF THE INVENTION

Definitions

Quality

Figure 1:
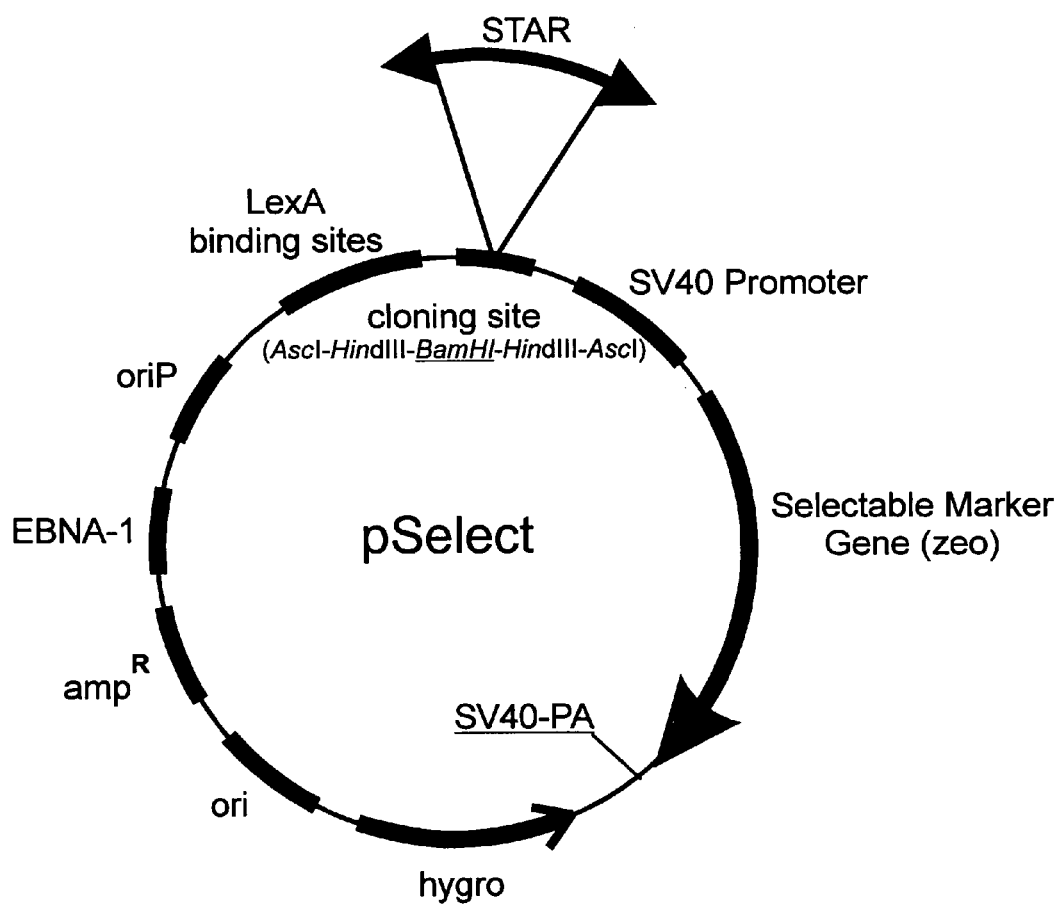
FIG. 1 is a diagram illustrating the pSelect plasmid used for isolating STAR elements. The zeocin resistance gene is under control of the SV40 promoter, and is upstream of the SV40 polyadenylation site. Upstream of the SV40 promoter is a tandem array of lexA operator sites. Between the lexA operators and the SV40 promoter is a cloning site; test DNAs (e.g., size-fractionated genomic DNA) are cloned into the BamHI site. The plasmid also has the hygromycin resistance gene (hygro) for selection of transformed cells, the EBNA-1 and oriP sequences for plasmid replication in mammalian cells, and the ampicillin resistance gene (ampR) and ori sequence for propagation in *Escherichia coli*.

The term "quality" in relation to a sequence refers to an activity of the sequence.

STAR and STAR Sequence

The terms "STAR," "STAR sequence" or "STAR element," as used herein, refer to a DNA sequence comprising one or more of the mentioned gene transcription modulating qualities.

DNA Sequence

The term "DNA sequence" as used herein, unless otherwise specified, does not refer to a listing of specific ordering of bases, but rather to a physical piece of DNA. A transcription quality with reference to a DNA sequence refers to an effect that the DNA sequence has on transcription of a gene of interest. "Quality" as used herein refers to detectable properties or attributes of a nucleic acid or protein in a transcription system.

Proteinaceous Molecule

By a "proteinaceous molecule" is meant herein a molecule comprising amino acids. At least a part of the amino acids are bound to each other to form a peptide. Preferably, the proteinaceous molecule comprises a polypeptide. In this application, the term "proteinaceous molecule" also includes "polypeptide."

Essentially the Same Properties

By "essentially the same properties" is meant that the properties are essentially the same in kind, not necessarily in amount. For instance, if a proteinaceous molecule has essentially the same properties as a pharmaceutically active compound, the proteinaceous molecule also displays such pharmaceutical activity in kind, not necessarily in amount.

Naturally Occurring Proteinaceous Molecule of the Same Kind

By a "naturally occurring proteinaceous molecule of the same kind" is meant a proteinaceous molecule with the same primary structure, which is naturally produced in vivo, not influenced by human interference. Examples comprise an antibody produced in vivo by a lymphocyte and erythropoietin produced in vivo by a hepatocyte.

Host Cell, Host Cell Line

As used herein, the terms "host cell" and "host cell line" refer to a cell and to homogeneous populations thereof that are capable of expressing a nucleic acid encoding a proteinaceous molecule.

Recombinant Host Cell, Recombinant Host Cell Line

The terms "recombinant host cell" and "recombinant host cell line" refer to a host cell and to homogeneous populations thereof into which a nucleic acid has been introduced.

Expression

As used herein, the term "expression" refers to production of a proteinaceous molecule, encoded by a nucleic acid. The production, for instance, involves transcription of a DNA sequence, translation of the corresponding mRNA sequence, and/or posttranslational modification. In case of secreted proteins, it can also refer to the processes of transcription, translation, and/or post-translational modification (e.g., glycosylation, disfulfide bond formation, etc.), followed by exocytosis. In the case of multimeric proteins, it can include assembly of the multimeric structure from the polypeptide monomers.

Silencing

The term "silencing" refers to diminution of a level of expression of a gene or genes, including transgenes, typically over time. The expression level can be diminished but still detectable, or diminished below the threshold of detection.

Enhanced Expression

As used herein, "enhanced expression" of a gene encoding a proteinaceous molecule, or enhanced production of a proteinaceous molecule, can either involve a higher yield of the proteinaceous molecule, a higher proportion of host cells with acceptable expression levels, and/or a higher stability of a gene expression level.

Affiliated Proteinaceous Molecule of a Cell

By an "affiliated proteinaceous molecule of a cell" is meant a proteinaceous molecule which is naturally produced by the kind of cell in the organism from which the cell is derived.

For instance, erythropoietin is an affiliated proteinaceous molecule of a hepatocyte, or of a hepatocyte-derived cell line. Likewise, an antibody is an affiliated proteinaceous molecule of a lymphocyte, or of a lymphocyte-derived cell line, typically of a B-cell or a B-cell derived cell line.

Specific Host Cell Line

A "specific host cell line" is a host cell line derived from a cell which normally expresses a particular proteinaceous molecule (or class of proteinaceous molecules) in the organism from which the cell is derived.

Heterologous STAR Sequence

The term "heterologous STAR sequence" is herein used to define a STAR sequence that is, for example, obtained from a different cell type (from the same species or organism) or is obtained from a different species or organism (either from the same cell type or a different cell type) compared to the cell in which it is used.

Stable

"Stable" means that the observed transcription level is not significantly changed over at least 30 cell divisions. A stable quality is useful in situations wherein expression characteristics should be predictable over many cell divisions. Typical examples are cell lines transfected with foreign genes. Other examples are transgenic animals and plants and gene therapies. Very often, introduced expression cassettes function differently after increasing numbers of cell divisions or plant or animal generations. A stable quality preferably comprises a capacity to maintain gene transcription in subsequent generations of a transgenic plant or animal. Of course, in the case where expression is inducible, the quality comprises the quality to maintain inducibility of expression in subsequent generations of a transgenic plant or animal.

Acceptable Expression Level

An "acceptable expression level" means an acceptable expression level for commercial exploitation. Whether or not a certain expression level is acceptable for commercial exploitation often depends on the kind of proteinaceous molecule that is produced. Acceptable expression levels of different kinds of proteinaceous molecules often involve different amounts of produced proteinaceous molecule.

A STAR sequence, a collection of STAR sequences, and/or a nucleic acid comprising a STAR sequence obtainable by a method of the invention, is of course suitable for use in a method of the invention for producing a proteinaceous molecule in a cell. In one aspect, the invention, therefore, provides a method for producing a proteinaceous molecule in a cell comprising selecting a cell for its suitability for producing the proteinaceous molecule, providing a nucleic acid encoding the proteinaceous molecule with a nucleic acid comprising a STAR sequence, expressing the resulting nucleic acid in the cell and collecting the proteinaceous molecule, wherein the nucleic acid comprising a STAR sequence is obtainable by a method of the invention for identifying and obtaining a nucleic acid comprising a STAR sequence. The nucleic acid comprising a STAR sequence can be identified and obtained using at least one pattern that is representative for sequences comprising STAR activity. Preferably, the nucleic acid comprising a STAR sequence is identified and obtained using at least one pattern as depicted in Table 6 (SEQ ID NOS:177-342) or Table 7 (SEQ ID NOS:343-1072).

A cell can be selected for its suitability for producing a proteinaceous molecule in many different ways. For instance, it can be determined whether the cell is competent of nucleic acid uptake. A nucleic acid encoding a proteinaceous molecule is preferably easily introduced into the cell. Furthermore it can be determined whether the cell secretes produced proteinaceous molecule. Secreted proteinaceous molecule can usually be easily collected. Collecting proteinaceous molecules that are not secreted usually involves sacrificing at least part of a culture. This implicates separating a proteinaceous molecule of interest from other cell components, optionally starting up a new culture, etc. This is more cumbersome. Hence, in a preferred embodiment, a method of the invention is provided wherein the proteinaceous molecule is secreted by the cell.

In another preferred embodiment, a method of the invention is provided wherein the cell is selected for its capability of post-translationally modifying the proteinaceous molecule, such that the proteinaceous molecule has essentially the same properties as a naturally occurring proteinaceous molecule of the same kind. As has been explained above, different kinds of cells display different post-translational modifications. As a result, the same proteinaceous molecule can be modified differently when produced in different host cells. These differences can affect the properties of such proteinaceous molecules, such as for instance pharmaceutical properties. It is, therefore, highly preferred to select a cell which produces a proteinaceous molecule with essentially the same properties as its naturally occurring counterpart. This does not necessarily mean that the host cell has to display exactly the same kind of post-translational modifications, as long as the produced proteinaceous molecule has essentially the same properties. A proteinaceous molecule can be produced that is physically different from its natural counterpart, but which is functionally essentially the same.

In one embodiment, of the invention, however, a cell is selected for its capability of post-translationally modifying the proteinaceous molecule in essentially the same way as the proteinaceous molecule is post-translationally modified in nature.

In one aspect, the invention provides a method of the invention wherein the proteinaceous molecule comprises an affiliated proteinaceous molecule of the cell.

It is especially preferred to choose a host cell, or a cell line derived from a cell, which normally produces a proteinaceous molecule of interest in the organism from which the cell is derived. These cells are capable of carrying out post-translational modifications of their affiliated proteinaceous molecules such that the resulting proteinaceous molecule has the same kind of properties in kind, not necessarily in amount, as a proteinaceous molecule of the same kind which is normally present in the organism. Such specific cells are naturally adapted for production of the affiliated proteinaceous molecule. Apart from other activities of STAR sequences it is also possible to at least partly solve a problem of low production of proteinaceous molecules, which often occurs with such specific cells. Providing at least one STAR sequence to a nucleic acid encoding such proteinaceous molecule will enhance production (yield) of the proteinaceous molecule by the specific cell, increase the proportion of host cells with acceptable expression levels, and/or increase stability of a gene expression level.

In another preferred embodiment, a method of the invention is disclosed wherein the cell is selected for suitable growth in a suspension culture. This facilitates culturing of the cell, and collection of produced proteinaceous molecule, especially when the proteinaceous molecule is secreted into the suspension. More preferably, the cell is selected for suitable growth in a serum-free culture, since serum can contain contaminants and pathogens. Such contaminants/pathogens often have to be separated from produced proteinaceous molecule. This requires an extra step, which consumes time and chemicals, with a potential loss of produced proteinaceous molecule. Moreover, a possibility of a presence of pathogens involves a potential risk for employees. If a pathogen has been present in a culture, a produced proteinaceous molecule is not allowed to be used anymore for commercial and/or medical applications.

In yet another preferred embodiment, the cell is selected for the presence of an adenovirus Early Region 1 (E1) sequence. The presence of an adenoviral E1 sequence enhances protein production in a cell. Hence, an adenoviral E1 sequence is suitable for host cells engineered for protein production.

The invention also provides a method for producing a proteinaceous molecule comprising:
  providing a host cell with a nucleic acid comprising a STAR sequence;
  selecting a cell with enhanced expression of a proteinaceous molecule; and
  collecting the proteinaceous molecule.

In one embodiment, the method is performed with a host cell whose genome has not been modified by human interference. The method then results in enhanced expression of a proteinaceous molecule which is encoded by the genome of the host cell. The proteinaceous molecule may be normally expressed by the host cell in the organism from which the cell is derived, but it may also normally be subject to silencing, resulting in little or no expression in the host cell under normal conditions. Introduction of at least one STAR sequence can at least in part inhibit silencing of a gene of interest induced by gene-transcription repressing chromatin. Expression of a proteinaceous molecule is enhanced by introduction of a STAR sequence.

In another embodiment, the host cell is transfected with a nucleic acid of interest. Such nucleic acid for instance, encodes a heterologous proteinaceous molecule which is not naturally encoded by the genome of the host cell. Introduction of a STAR sequence also enhances expression of such heterologous proteinaceous molecule.

The STAR sequence can be introduced randomly into the genome of the host cell, using methods known in the art (for instance calcium precipitation, transfection with a vector comprising a nucleic acid of interest, use of a gene delivery vehicle, etc). If a STAR sequence is introduced near a nucleic acid sequence encoding a proteinaceous molecule, it is capable of enhancing expression of the proteinaceous molecule. Cells expressing a desired proteinaceous molecule can be isolated from cultures with randomly inserted STAR sequences.

Preferably, the STAR sequence is introduced into the host cell by homologous recombination. A nucleic acid comprising a STAR sequence can be provided with an additional sequence. The additional sequence can be chosen such that it is at least in part homologous to a nucleic acid sequence in the host cell which is known to be present in vicinity of a gene encoding a proteinaceous molecule of interest. If a nucleic acid comprising a STAR sequence and such additional sequence is provided to the host cell, it can be incorporated into the host cell's genome by homologous recombination at the site with the (partly) homologous nucleic acid sequence. As a result, the STAR sequence is introduced in vicinity of the gene encoding the proteinaceous molecule of interest. Expression of the proteinaceous molecule is then enhanced by the introduced STAR sequence.

A preferred embodiment of the present invention provides a method of the invention wherein the STAR sequence comprises a species-specific STAR sequence. More preferably, the STAR sequence comprises a cell type-specific STAR sequence.

Two types of STAR elements have been identified. Promiscuous STAR elements are able to function in more than one host cell line. For example, STAR6 (SEQ ID NO:6) increases the predictability, yield, and stability of a transgene in both the U-2 OS human osteosarcoma cell line and in CHO (Chinese hamster ovary) cells. Other STAR elements are species-specific and/or cell type-specific; for example, STAR8 (SEQ ID NO:8) increases the predictability, yield, and stability of transgenes in U-2 OS cells, but not in CHO cells (see Examples 2 and 3 and FIGS. 3 and 4).

If a certain type of host cell (line) is chosen for expression of a proteinaceous molecule (for instance, because it is known to possess a preferred post-translational modification system) a STAR sequence which is naturally present in the cell can be used in a method of the invention. Such STAR sequence is referred to as a cell type-specific STAR sequence. A STAR sequence which is naturally present in a species from which the cell is derived can also be used. Such STAR sequence is referred to as a species-specific STAR sequence. A species-specific STAR sequence may be naturally present in the cell type, although this is not necessary.

A known species-specific STAR sequence or cell-type specific STAR sequence can be used in a method of the invention. Alternatively, a (previously unknown) species-specific STAR sequence or cell-type specific STAR sequence can be detected and isolated by a method as described by the present inventors (EP 01202581.3). The use of a species-specific STAR sequence or cell type-specific STAR sequence is preferred because such sequence is especially active in the host cell and is adapted to the specific circumstances within the cell. For instance, such cell type-specific STAR sequence may interact with a protein which is not present in some other cell-types. In that case, the cell type-specific STAR sequence will be less capable—if at all—of enhancing expression in cells lacking the protein. A species-specific or cell type-specific STAR element often has functional characteristics that are superior to promiscuous STAR elements. Furthermore, a cell line-specific STAR element can satisfy product safety or ethical considerations for use of the host cell line.

A promiscuous STAR sequence is particularly useful if no tissue specific or cell-type specific STAR sequence is known. In that case a known promiscuous STAR sequence can be used. This saves efforts to detect and isolate a cell-type specific STAR sequence.

Several STAR sequences are listed in SEQ ID NOS:1-119. Hence, in one aspect, a method of the invention is provided wherein the STAR sequence comprises a sequence as depicted in SEQ ID NOS:1-119.

In a preferred embodiment, the invention provides a cell line that comprises at least one heterologous STAR sequence or a functional equivalent and/or a functional fragment thereof. In an even more preferred embodiment, the cell line is a human cell line. The invention provides multiple examples of STAR sequences and also methods of testing STAR sequences and hence, a person skilled in the art is very well capable of obtaining a functional equivalent and/or a functional fragment of a STAR sequence, for example by deletion or mutation. In yet another preferred embodiment, the invention provides a non-human cell line that comprises at least one recombinant STAR sequence derived or obtained from a human cell, i.e., a human STAR sequence. It is clear that the amount of STAR sequences may vary, for example, a cell line according to the invention may comprise two, three, or four, or even more STAR sequences which may either be identical or different from each other.

In one aspect, the invention provides a cell line provided with a nucleic acid comprising a STAR sequence, wherein the cell line is selected for its suitability for producing a proteinaceous molecule. Preferably, a cell line of the invention comprises a vertebrate or plant cell line. A vertebrate cell line is very suitable for producing a human proteinaceous molecule of interest, because vertebrates are phylogenetically close related.

Plant cells are for instance very suitable for vaccine production. Vaccine production in plants can be inexpensive, while the vaccine can be easily delivered to an individual by eating the edible portion of the plant (Mercenier et al, 2001).

A cell line of the invention is particularly suitable for production of a proteinaceous molecule of interest, because the STAR sequence can enhance expression of a gene of interest (higher yield of a proteinaceous molecule, higher proportion of host cells with acceptable expression levels, and/or higher stability of a gene expression level). Methods for generating a cell line are known in the art and many techniques are known to provide a cell with a nucleic acid of interest. Furthermore, many general purpose cell lines are available. Such cell lines can be dedicated to production of a certain proteinaceous molecule using recombinant techniques. Examples of available cell lines include CHO cells from Chinese hamster ovary and BHK cells from baby hamster kidney (as described above).

Another embodiment of the invention provides a cell line provided with a nucleic acid comprising a STAR sequence, wherein the cell line comprises an adenovirus Early Region 1 sequence. As has been described above, an adenoviral E1 sequence enhances cellular protein production. More preferably a cell line of the invention is provided wherein the cell line comprises a U-2 OS osteosarcoma, CHO, 293, HuNS-1 myeloma, WERI-Rb-1 retinoblastoma, BHK, Vero, non-secreting mouse myeloma Sp2/0-Ag 14, non-secreting mouse myeloma NSO, or NCI-H295R adrenal gland carcinoma (ATCC CRL-2128) cell line.

A cell line of the invention is particularly suitable for production of a proteinaceous molecule, because production can be enhanced by one or more STAR sequences (higher yield of a proteinaceous molecule, higher proportion of host cells with acceptable expression levels, and/or higher stability of a gene expression level). A cell line of the invention can comprise promiscuous, species-specific and/or cell type-specific STAR sequences. Furthermore, a cell line of the invention can be used to produce a heterologous proteinaceous molecule, and/or an affiliated proteinaceous molecule.

Hence, a use of a cell line of the invention for the production of a proteinaceous molecule is also herewith provided. Preferably, the proteinaceous molecule comprises an affiliated protein of the cell line.

Of course, a proteinaceous molecule obtainable by a method of the invention is also provided by the present invention.

In one aspect, the invention provides a method for selecting a cell suitable for producing a proteinaceous molecule comprising:
providing a nucleic acid encoding the proteinaceous molecule with a nucleic acid comprising a STAR sequence;
expressing the resulting nucleic acid in the cell; and
determining whether produced proteinaceous molecule has a desired property.

The desired property, for instance, comprises a pharmaceutical property. The property can be influenced by post translational modification(s), a configuration of a produced proteinaceous molecule, etc.

In yet another aspect, the invention provides a method for selecting a cell suitable for producing a proteinaceous molecule comprising:
providing a host cell with a nucleic acid comprising a STAR sequence;
selecting a cell with enhanced expression of a proteinaceous molecule; and
determining whether the proteinaceous molecule has a desired property.

As has been discussed above, the nucleic acid comprising a STAR sequence can be randomly introduced into the genome of the host cell. Preferably, however, the nucleic acid sequence is introduced into the genome of the host cell by homologous recombination.

The invention is further explained in the following examples. The examples do not limit the invention in any way. They merely serve to clarify the invention.

EXAMPLES

Example 1

Method for Isolation of STAR Elements from the Human Genome

STAR elements are identified and cloned from human genomic DNA based on their ability to block the spread of transcriptional repression from DNA binding sites for repressor proteins in a test vector, as described in this example. The method described in this example is applicable in principle to any mammalian cell line, for isolation of both promiscuous and cell line-specific STAR elements.

A Method to Isolate Human STAR Elements Functional in U-2 OS Cell

Materials and Methods

Plasmids and strains. The selection vector for STAR elements, pSelect-SV40-zeo ("pSelect," FIG. 1) was constructed as follows: the pREP4 vector (Invitrogen V004-50) was used as the plasmid backbone. It provides the Epstein Barr oriP origin of replication and EBNA-1 nuclear antigen for high-copy episomal replication in primate cell lines; the hygromycin resistance gene with the thymidine kinase promoter and polyadenylation site, for selection in mammalian cells; and the ampicillin resistance gene and colE1 origin of replication for maintenance in *Escherichia coli*. The vector contains four consecutive LexA operator sites between XbaI and NheI restriction sites (Bunker & Kingston, 1994). Embedded between the LexA operators and the NheI site is a polylinker consisting of the following restriction sites: HindIII-AscI-BamHI-AscI-HindIII. Between the NheI site and a SalI site is the zeocin resistance gene with the SV40 promoter and polyadenylation site, derived from pSV40/Zeo (Invitrogen V502-20); this is the selectable marker for the STAR screen.

Gene libraries were constructed by Sau3AI digestion of human genomic DNA, either purified from placenta (Clontech 6550-1) or carried in bacterial/P1 (BAC/PAC) artificial chromosomes. The BAC/PAC clones contain genomic DNA from the 1q12 cytogenetic region (clones RP1154H19 and RP3328E19), from the HOX cluster of homeotic genes (clones RP1167F23, RP1170019, and RP11387A1), or from human chromosome 22 (Research Genetics 96010-22). The DNAs were size-fractionated, and the 0.5-2 kb size fraction ligated into BamHI-digested pSelect vector, by standard techniques (Sambrook et al., 1989).

The construction of the host strains has been described (van der Vlag et al., 2000). Briefly, they are based on the U-2 OS human osteosarcoma cell line (American Type Culture Collection HTB-96). U-2 OS was stably transfected with the pTet-Off plasmid (Clontech K1620-A), encoding a protein chimera consisting of the Tet-repressor DNA binding domain and the VP16 transactivation domain. The cell line was subsequently stably transfected with fusion protein genes containing the LexA DNA binding domain, and the coding regions of HP1, MeCP2, or HPC2 (three *Drosophila* proteins that repress gene expression when tethered to DNA). The LexA-repressor genes are under control of the Tet-Off transcriptional regulatory system (Gossen & Bujard, 1992).

Library screening and STAR element characterization. The gene libraries in pSelect were transfected into U-2 OS/Tet-Off/LexA-repressor cell lines by calcium phosphate precipitation (Graham & van der Eb, 1973, Wigler et al., 1978) as recommended by the supplier of the transfection reagent (Life Technologies). Transfected cells were cultured under hygromycin selection (25 µg/ml) and tetracycline repression (doxycycline, 10 ng/ml) for one week (50% confluence). Then the doxycycline concentration was reduced to 0.1 ng/ml to induce the LexA-repressor genes, and after two days zeocin was added to 250 µg/ml. The cells are cultured for a further four to five weeks, until the control cultures (transfected with empty pSelect) were killed by the zeocin.

Zeocin-resistant colonies from the library transfection were propagated, and plasmid DNA isolated and rescued into *E. coli* by standard techniques (Sambrook et al., 1989). The candidate STAR elements in the rescued DNA were analyzed by restriction endonuclease mapping (Sambrook et al., 1989), and tested for STAR activity (zeocin resistance) after re-transfection to U-2 OS/Tet-Off/LexA-repressor cells and lowering the doxycycline concentration.

The human genomic DNA inserts in these plasmids were sequenced by the dideoxy method (Sanger et al., 1977) using a Beckman CEQ™ 2000 automated DNA sequencer, using the manufacturer's instructions. Briefly, DNA was purified from *E. coli* using QIAprep® Spin Miniprep and Plasmid Midi Kits (QIAGEN® 27106 and 12145, respectively). Cycle sequencing was carried out using custom oligonucleotides corresponding to the pSelect vector (primers D89 (SEQ ID NO:149) and D95 (SEQ ID NO:154); all oligonucleotides are described in Table 2), in the presence of dye terminators (CEQ™ Dye Terminator Cycle Sequencing Kit, Beckman 608000). Assembled STAR DNA sequences were located in the human genome using BLAST (Basic Local Alignment Search Tool (Altschul et al., 1990); on the web at ncbi.nlm.nih.gov/BLAST/).

Results

The screens of human genomic DNA have yielded 66 STAR elements; the lengths and chromosomal locations of these elements are tabulated in SEQ ID NO:1-SEQ ID NO:66. They confer zeocin resistance on U-2 OS host cells when placed between LexA-repressor binding sites and the zeocin resistance gene. Their anti-repression activity was demonstrated both in the initial screen and upon re-transfection (demonstrating that the anti-repression activity is due to the STAR element and not to somatic acquisition of zeocin resistance). The STAR elements correspond to known and unique sequences in the human genome, as demonstrated by BLAST searches (Table 3). In some cases, the cloned element is a chimera of two unlinked genomic loci (e.g., STAR3 (SEQ ID NO:3), Table 3). They range in length from 500 to 2361 base pairs in length.

Example 2

Predictability and Yield is Improved by Promiscuous Star Elements in More than One Host Cell Line STAR elements function to block the effect of transcriptional repression influences on transgene expression units. These repression influences can be due to heterochromatin ("position effects") or to adjacent copies of the transgene ("repeat-induced gene silencing"). Two of the benefits of STAR elements for heterologous protein production are increased predictability of finding high-expressing primary recombinant host cells and increased yield during production cycles. These benefits are illustrated in this example.

Materials and Methods

Figure 2:
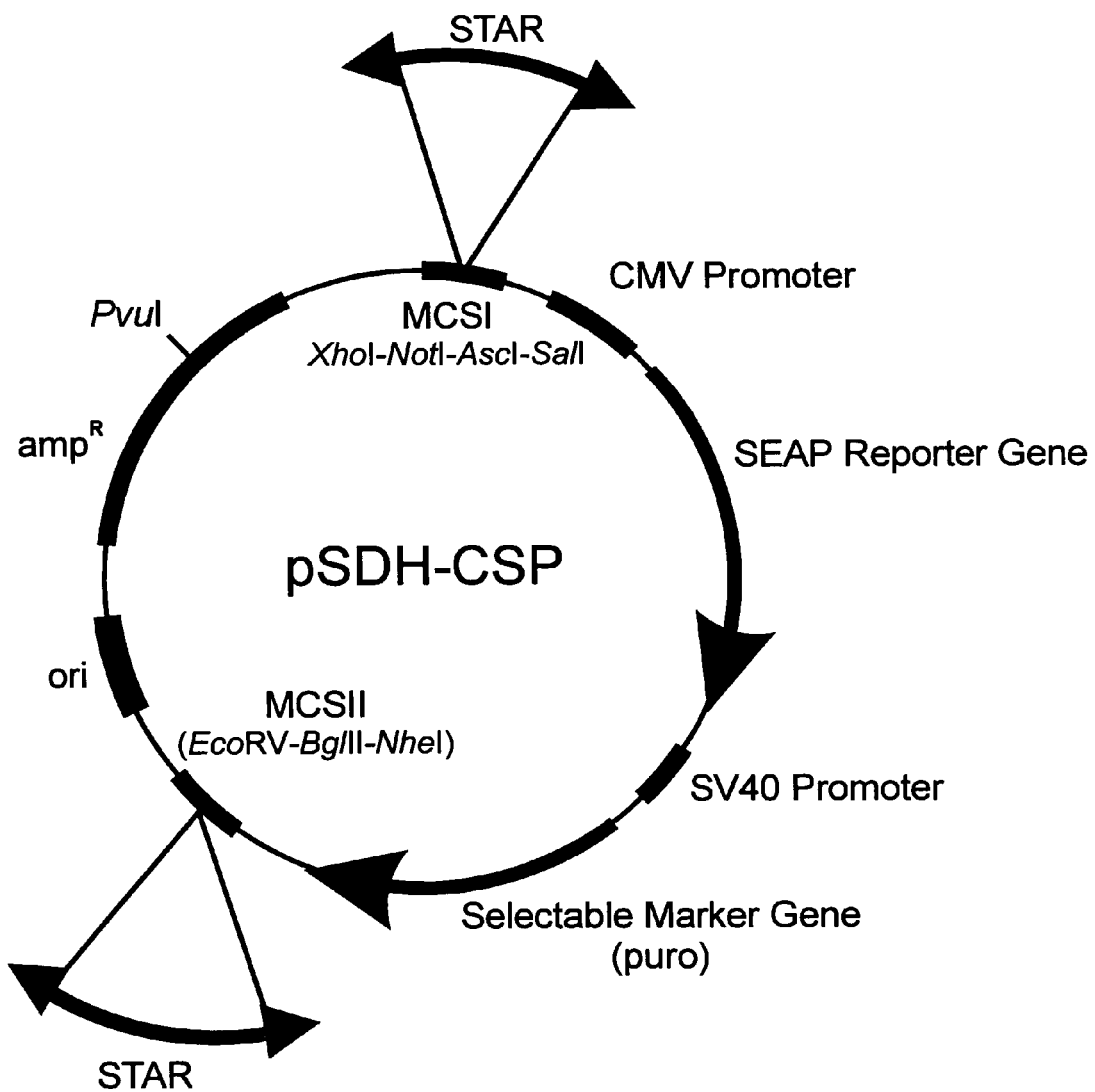
FIG. 2 is a diagram depicting the pSDH-CSP plasmid used for testing STAR activity. The Secreted Alkaline Phosphatase (SEAP) reporter gene is under control of the CMV promoter, and the puromycin resistance selectable marker (puro) is under control of the SV40 promoter. Flanking these two genes are multiple cloning sites (MCSI and MCSII) into which STAR elements can be cloned. The plasmid also has an origin of replication (ori) and ampicillin resistance gene ($amp^R$) for propagation in *Escherichia coli*.

Construction of the pSDH vectors and STAR-containing derivatives: The pSDH-Tet vector was constructed by polymerase chain reaction amplification (PCR) of the luciferase open reading frame from plasmid pREP4-HSF-Luc (van der Vlag et al., 2000) using primers C67 (SEQ ID NO:136) and C68 (SEQ ID NO:137), and insertion of the SacII/BamHI fragment into SacII/BamHI-digested pUHD10-3 (Gossen & Bujard, 1992). The luciferase expression unit was re-amplified with primers C65 (SEQ ID NO:134) and C66 (SEQ ID NO:135), and re-inserted into pUHD10-3 in order to flank it with multiple cloning sites (MCSI and MCSII). An AscI site was then introduced into MCSI by digestion with EcoRI and insertion of a linker (comprised of annealed oligonucleotides D93 (SEQ ID NO:152) and D94 (SEQ ID NO:153)). The CMV promoter was amplified from plasmid pCMV-Bsd (Invitrogen K510-01) with primers D90 (SEQ ID NO:150) and D91 (SEQ ID NO:151), and used to replace the Tet-Off promoter in pSDH-Tet by SalI/SacII digestion and ligation to create vector pSDH-CMV. The luciferase open reading frame in this vector was replaced by SEAP (Secreted Alkaline Phosphatase) as follows: vector pSDH-CMV was digested with SacII and BamHI and made blunt; the SEAP open reading frame was isolated from pSEAP-basic (Clontech 6037-1) by EcoRI/SalI digestion, made blunt and ligated into pSDH-CMV to create vector pSDH-CS. The puromycin resistance gene under control of the SV40 promoter was isolated from plasmid pBabe-Puro (Morgenstern & Land, 1990) by PCR, using primers C81 (SEQ ID NO:138) and C82 (SEQ ID NO:139). This was ligated into vector pGL3-control (BamHI site removed) (Promega E1741) digested with NcoI/XbaI to create pGL3-puro. pGL3-puro was digested with BglII/SalI to isolate the SV40-puro resistance unit, which was made blunt and ligated into NheI digested, blunt-ended pSDH-CS. The resulting vector, pSDH-CSP, is shown in FIG. 2. All cloning steps were carried out following the instructions provided by the manufacturers of the reagents used, according to methods known in the art (Sambrook et al., 1989).

STAR elements were inserted into MCSI and MCSII in two steps, by digestion of the STAR element and the pSDH-CSP vector with an appropriate restriction enzyme, followed by ligation. The orientation of STAR elements in recombinant pSDH vectors was determined by restriction mapping, and in all cases verified by DNA sequence analysis using primers C85 (SEQ ID NO:140), E42 (SEQ ID NO:168), and E25 (SEQ ID NO:167) (Table 2; see Example 1).

Transfection and culture of U-2 OS cells with pSDH-CMV plasmids: The human osteosarcoma U-2 OS cell line (ATCC #HTB-96) was cultured in Dulbecco's Modified Eagle Medium+10% Fetal Calf Serum containing glutamine, penicillin, and streptomycin (supra) at 37° C./5% $CO_2$. Cells were co-transfected with the pSDH-CMV vector and its derivatives containing STAR6 (SEQ ID NO:6) or STAR8 (SEQ ID NO:8) in MCSI and MCSII (along with plasmid pBabe-Puro) using SuperFect® (supra). Puromycin selection was complete in two weeks, after which time individual puromycin resistant U-2 OS/pSDH-CMV clones were isolated at random and cultured further.

Luciferase assay: Luciferase activity (Himes & Shannon, 2000) was assayed in resuspended cells according to the instructions of the assay kit manufacturer (Roche 1669893), using a luminometer (Turner 20/20TD). Total cellular protein concentration was determined by the bicinchoninic acid method according to the manufacturer's instructions (Sigma B-9643), and used to normalize the luciferase data.

Transfection and culture of CHO cells with pSDH-CSP plasmids: The Chinese Hamster Ovary cell line CHO-K1 (ATCC CCL-61) was cultured in HAMS-F12 medium+10% Fetal Calf Serum containing 2 mM glutamine, 100 U/ml penicillin, and 100 micrograms/ml streptomcyin at 37° C./5% $CO_2$. Cells were transfected with recombinant pSDH-CSP vectors using SuperFect® (QIAGEN®) as described by the manufacturer. Briefly, cells were seeded to culture vessels and grown overnight to 70-90% confluence. SuperFect® reagent was combined with plasmid DNA (linearized in this example by digestion with PvuI) at a ratio of 6 microliters per microgram (e.g., for a 10 cm Petri dish, 20 micrograms DNA and 120 microliters SuperFect®) and added to the cells. After overnight incubation, the transfection mixture was replaced with fresh medium, and the transfected cells were incubated further. After overnight cultivation, 5 micrograms/ml puromycin was added. Puromycin selection was complete in two weeks, after which time individual puromycin resistant CHO/pSDH-CSP clones were isolated at random and cultured further.

Secreted Alkaline Phosphatase (SEAP) assay: SEAP activity (Berger et al., 1988, Henthorn et al., 1988, Kain, 1997, Yang et al., 1997) in the culture medium of CHO/pSDH-CSP clones was determined as described by the manufacturer (Clontech Great EscAPe kit #K2041). Briefly, an aliquot of medium was heat inactivated at 65° C., then combined with assay buffer and CSPD chemiluminescent substrate and incubated at room temperature for ten minutes. The rate of substrate conversion was then determined in a luminometer (Turner 20/20TD). Cell density was determined by counting trypsinized cells in a Coulter ACT10 cell counter. Luminescence units were converted into picograms SEAP based on a SEAP positive control calibration curve, and normalized to cell number.

Results

Recombinant U-2 OS cell clones containing the pSDH-CMV vector, or a pSDH-CMV plasmid containing STAR6 (SEQ ID NO:6) (Table 3), were cultured for three weeks. The luciferase activity in the host cells was then determined, and is expressed as relative luciferase units (FIG. 3), normalized to total cell protein. The recombinant U-2 OS clones with STAR6 (SEQ ID NO:6) flanking the expression units had higher yields than the STAR-less clones: the STAR6 clones had maximal luciferase expression levels five-fold higher than the STAR-less clones. The STAR6 (SEQ ID NO:6) element conferred greater predictability as well: 15-20% of the clones expressed luciferase at levels comparable to or greater than the STAR-less clone with the highest expression level.

Figure 4:
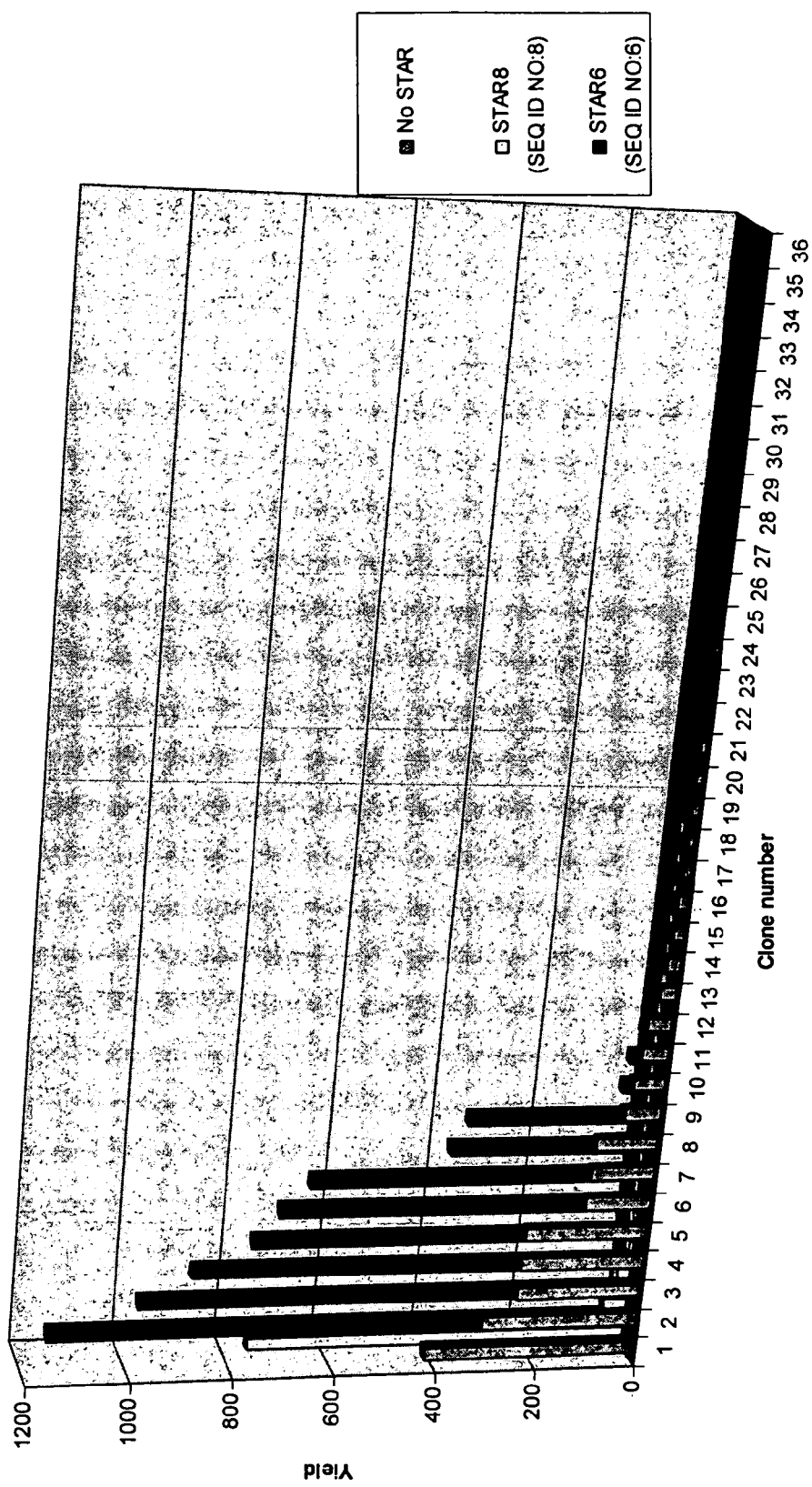
FIG. 4 is a graph illustrating that STAR6 (SEQ ID NO:6), but not STAR8 (SEQ ID NO:8), improves predictability and yield of transgene expression in CHO cells. Expression of SEAP from the CMV promoter by CHO cells transfected with pSDH-CSP, pSDH-CSP-STAR6, or pSDH-CSP-STAR8 was determined. The STAR6-containing constructs confer greater predictability and elevated yield relative to the pSDH-CSP construct alone, identifying STAR6 (SEQ ID NO:6) as a promiscuous STAR element. In contrast, the STAR8-containing constructs do not consistently increase yield or predictability relative to the pSDH-CSP construct, suggesting that STAR8 (SEQ ID NO:8) is a cell line-specific STAR element.
Figure 5:
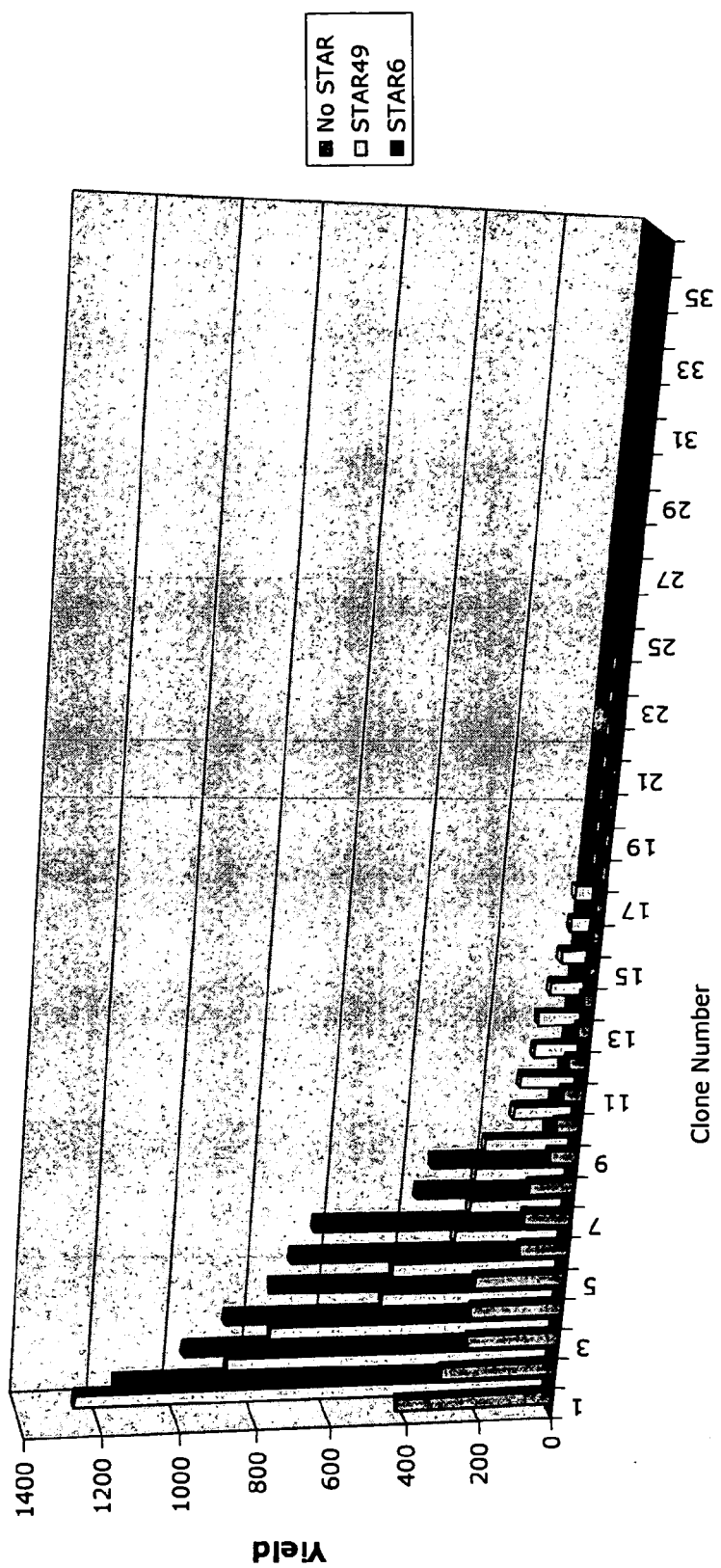
FIG. 5 is a graph depicting that STAR6 (SEQ ID NO:6) and STAR49 (SEQ ID NO:49) improve predictability and yield of transgene expression. Expression of SEAP from the CMV promoter by CHO cells transfected with pSDH-CSP, pSDH-CSP-STAR6, or pSDH-CSP-STAR49 was determined. The STAR-containing constructs confer greater predictability and elevated yield relative to the pSDH-CSP construct alone.

Recombinant CHO cell clones containing the pSDH-CSP vector, or a pSDH-CSP plasmid containing STAR6 (SEQ ID NO:6), were cultured for three weeks. The SEAP activity in the culture supernatants was then determined, and is expressed on the basis of cell number (FIG. 4). As can be seen, clones with the STAR6 (SEQ ID NO:6) element in the expression units were isolated that express two- to three-fold higher SEAP activity than clones whose expression units do not include this STAR element. Furthermore, the number of STAR6-containing (SEQ ID NO:6-containing) clones that express SEAP activity at or above the maximal activity of the STAR-less clones is quite high: 40% of the STAR6 clone populations exceed the highest SEAP expression of the pSDH-CSP clones.

These results demonstrate that, when used with the strong CMV promoter, the STAR6 (SEQ ID NO:6) element increases the yield of this heterologous protein in both of the host cell lines tested. STAR6 (SEQ ID NO:6) also confers increased predictability, as manifested by the large proportion of the clones with yields equal to or greater than the highest yield displayed by the STAR-less clones. Thus, STAR6 (SEQ ID NO:6) is an example of a promiscuous STAR element, able to suppress transgene repression in more than one host cell line. The cell lines used are derived from different species (human and hamster) and different tissue types (bone and ovary), reflecting the broad range of host cells in which this STAR element can be utilized in improving heterologous protein expression.

Example 3

STAR8 (SEQ ID NO:8) is a Cell Line-specific STAR Element

The patterns of gene expression and epigenetic gene regulation in a host cell line reflect the developmental state of the somatic cells from which they are derived. Furthermore, the biotechnology industry takes advantage of general purpose cell lines from different species according to specific requirements of a heterologous protein production process. Therefore, it is expected that some STAR elements will not function in cell lines other than those in which they are isolated. This expectation has been fulfilled by some of the STAR elements shown in Table 3. One example will be given here.

Materials and Methods pSDH vector construction, transfection and cultivation of CHO and U-2 OS cell lines, and assay methods for the SEAP and luciferase reporter genes has been described in Example 2.

Results

Recombinant U-2 OS cell clones containing the pSDH-CMV vector, or a pSDH-CMV plasmid containing STAR8 (SEQ ID NO:8) (Table 3), were cultured for three weeks. The luciferase activity in the host cells was then determined, and is expressed as relative luciferase units (FIG. 3), normalized to total cell protein. The recombinant U-2 OS clones with the STAR8 (SEQ ID NO:8) element flanking the expression units had higher yields than the STAR-less clones: the highest expression observed from STAR8 clones was two- to three-fold higher than the expression from STAR-less clones. The STAR8 (SEQ ID NO:8) element conferred greater predictability as well: for this STAR element, ~15% of the clones displayed luciferase expression at levels comparable to or greater than the STAR-less clone with the highest expression level.

Recombinant CHO cell clones transfected with the pSDH-CSP vector, or a pSDH-CSP plasmid containing STAR8 (SEQ ID NO:8), were cultured for three weeks. The SEAP activity in the culture supernatants was then determined, and is expressed on the basis of cell number (FIG. 4). As can be seen, one clone with the STAR8 (SEQ ID NO:8) element in the expression unit had a yield approximately two-fold higher than the highest-expressing STAR-less clone. However, the rest of the STAR8 clones expressed very poorly relative to the STAR-less clone population. Since only one individual in the STAR8 population had a good yield, it is probable that the expression unit in this clone was integrated in open, transcriptionally active chromatin, and the high yield does not reflect anti-repression activity of STAR8 (SEQ ID NO:8) in CHO cells. Certainly in the CHO clones transfected with STAR8-containing (SEQ ID NO:8-containing) expression units the predictability is quite poor; of the 17 puromycin-resistant clones, only one clone had a yield of SEAP activity above the background level of expression.

This example demonstrates that good performance of a STAR element in one cell line (in this case, the U-2 OS cell line in which STAR8 (SEQ ID NO:8) was originally isolated) is not an accurate predictor of its performance in other cell lines. STAR8 (SEQ ID NO:8) is thus an example of a cell line-specific STAR element.

Example 4

STAR Elements Functionality in Diverse Cell Line

Materials and Methods

Cell lines including the U-2 OS osteosarcoma and CHO (Chinese hamster ovary) cell lines (supra), the 293 cell line (ATCC CRL-1573) derived from human embryonal kidney (immortalized by adenovirus 5 transfection), the HuNS-1 myeloma (ATCC CRL-8644) and the WERI-Rb-1 retinoblastoma cell line (ATCC HTB-169), the NCI-H295R adrenal gland carcinoma (ATCC CRL-2128), and the non-secreting mouse myelomas Sp2/0-Ag 14 and NSO are examined according to the previous examples.

Example 5

STAR Elements Improve the Stability of Transgene Expression

During cultivation of recombinant host cells, it is common practice to maintain antibiotic selection. This is intended to prevent transcriptional silencing of the transgene, or loss of the transgene from the genome by processes such as recombination. However it is undesirable for production of heterologous proteins, for a number of reasons. First, the antibiotics that are used are quite expensive, and contribute significantly to the unit cost of the product. Second, for biopharmaceutical use, the protein must be demonstrably pure, with no traces of the antibiotic in the product. One advantage of STAR elements for heterologous protein production is that they confer stable expression on transgenes during prolonged cultivation, even in the absence of antibiotic selection; this property is demonstrated in this example.

Materials and Methods

The U-2 OS cell line was transfected with the plasmid pSDH-Tet-STAR6 and cultivated as described in Example 2. Individual puromycin-resistant clones were isolated and cultivated further in the absence of doxycycline. At weekly intervals the cells were transferred to fresh culture vessels at a dilution of 1:20. Luciferase activity was measured at periodic intervals as described in Example 2. After 15 weeks, the cultures were divided into two replicates; one replicate continued to receive puromycin, while the other replicate received no antibiotic for the remainder of the experiment (25 weeks total).

Results

Table 4 presents the data on luciferase expression by an expression unit flanked with STAR6 (SEQ ID NO:6) during prolonged growth with or without antibiotic. As can be seen, the expression of the reporter transgene, luciferase, remains stable in the U-2 OS host cells for the duration of the experiment. After the cultures were divided into two treatments (plus antibiotic and without antibiotic) the expression of luciferase was essentially stable in the absence of antibiotic selection. This demonstrates the ability of STAR elements to protect transgenes from silencing or loss during prolonged cultivation. It also demonstrates that this property is independent of antibiotic selection. Therefore, production of heterologous proteins is possible without incurring the costs of the antibiotic or of difficult downstream processing.

Example 6

Minimal Essential Sequences of STAR Elements

STAR elements are isolated from the genetic screen described in Example 1. The screen uses libraries constructed with human genomic DNA that was size-fractionated to approximately 0.5-2 kilobases (supra). The STAR elements range from 500 to 2361 base pairs (Table 3). It is likely that, for many of the STAR elements that have been isolated, STAR activity is conferred by a smaller DNA fragment than the initially isolated clone. It is useful to determine these minimum fragment sizes that are essential for STAR activity, for two reasons. First, smaller functional STAR elements would be advantageous in the design of compact expression vectors, since smaller vectors transfect host cells with higher efficiency. Second, determining minimum essential STAR sequences permits the modification of those sequences for enhanced functionality. Two STAR elements have been fine-mapped to determine their minimal essential sequences.

Materials and Methods

Figure 6:
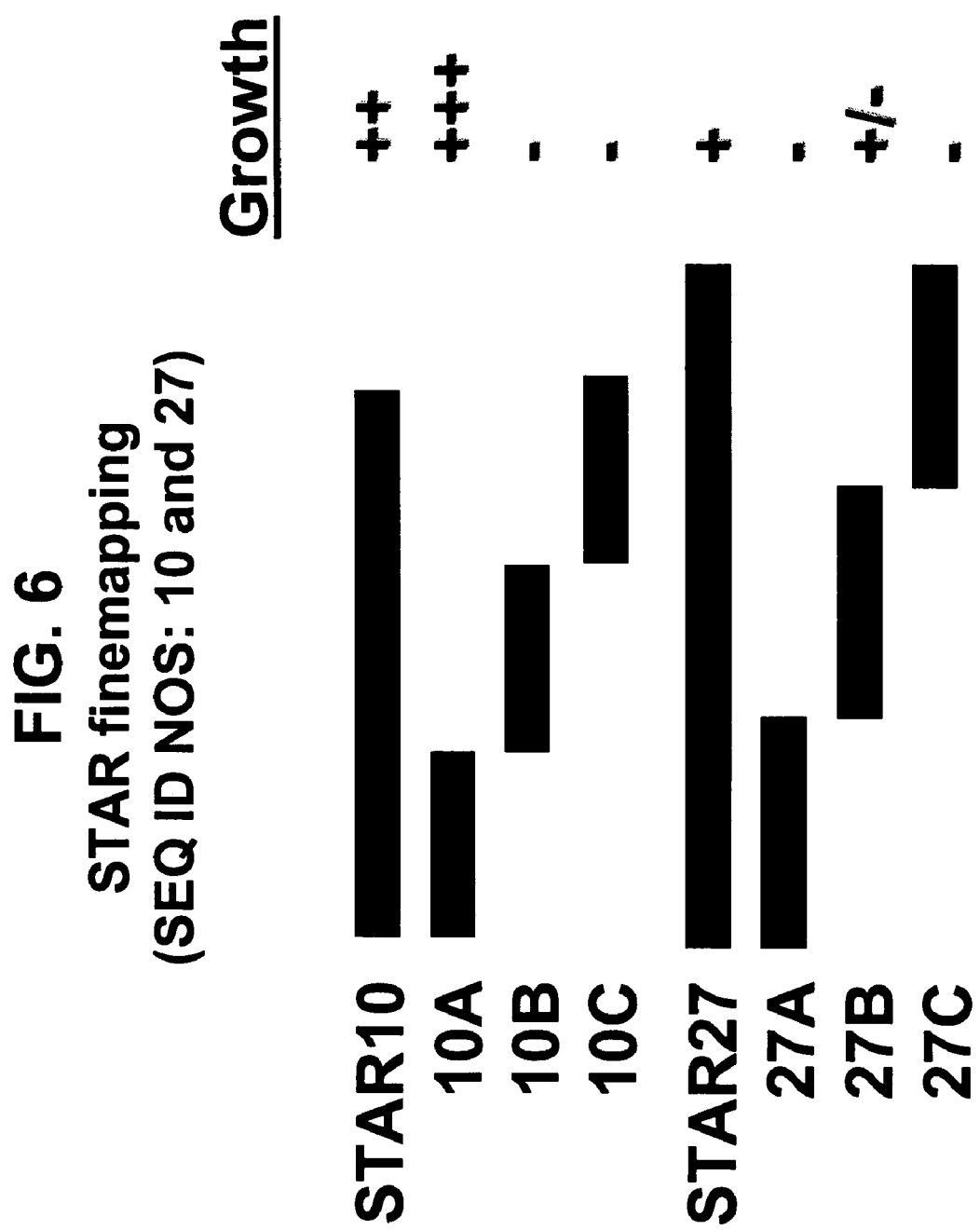
FIG. 6 is a graph showing the minimal essential sequences of STAR10 (SEQ ID NO:10) and STAR27 (SEQ ID NO:27). Portions of the STAR elements were amplified by PCR: STAR10 (SEQ ID NO:10) was amplified with primers E23 (SEQ ID NO:166) and E12 (SEQ ID NO:155) to yield fragment 10A (corresponding approximately to the first 400 nucleotides of SEQ ID NO:10), E13 (SEQ ID NO:156) and E14 (SEQ ID NO:157) to yield fragment 10B (corresponding approximately to the second 400 nucleotides of SEQ ID NO:10), and E15 (SEQ ID NO:158) and E16 (SEQ ID NO:159) to yield fragment 10C (corresponding approximately to the third 400 nucleotides of SEQ ID NO:10). STAR27 (SEQ ID NO:27) was amplified with primers E17 (SEQ ID NO:160) and E18 (SEQ ID NO:161) to yield fragment 27A (corresponding approximately to the first 500 nucleotides of SEQ ID NO:27), E19 (SEQ ID NO:162) and E20 (SEQ ID NO:163) to yield fragment 27B (corresponding to the second 500 nucleotides of SEQ ID NO:27), and E21 (SEQ ID NO:164) and E22 (SEQ ID NO:165) to yield fragment 27C (corresponding approximately to the third 500 nucleotides of SEQ ID NO:27). These sub-fragments were cloned into the pSelect vector. After transfection into U-2 OS/Tet-Off/LexA-HP1 cells, the growth of the cultures in the presence of zeocin was monitored. Growth rates varied from vigorous (+++) to poor (+/−), while some cultures failed to survive zeocin treatment (−) due to absence of STAR activity in the DNA fragment tested.

STAR10 (SEQ ID NO:10) (1167 base pairs) and STAR27 (SEQ ID NO:27) (1520 base pairs) have been fine-mapped. They have been amplified by PCR to yield sub-fragments of approximately equal length (FIG. 6 legend). For initial testing, these have been cloned into the pSelect vector at the BamHI site, and transfected into U-2 OS/Tet-Off/LexA-HP1 cells as described in Example 1. After selection for hygromycin resistance, LexA-HP1 was induced by lowering the doxycycline concentration. Transfected cells were then incubated with zeocin to test the ability of the STAR fragments to protect the SV40-Zeo expression unit from repression due to LexA-HP1 binding.

Results

In this experiment STAR10 (SEQ ID NO:10) and STAR 27 (SEQ ID NO:27) confer good protection against gene silencing, as expected (FIG. 6). This is manifested by robust growth in the presence of zeocin.

Of the three STAR10 (SEQ ID NO:10) sub-fragments, 10A (~400 base pairs, corresponding to approximately the first 400 nucleotides of SEQ ID NO:10) confers on transfected cells vigorous growth in the presence of zeocin, exceeding that of the full-length STAR element. Cells transfected with pSelect constructs containing the other two sub-fragments do not grow in the presence of zeocin. These results identify the ~400 base pair 10A fragment as encompassing the DNA sequence responsible for the anti-repression activity of STAR10 (SEQ ID NO:10).

STAR27 (SEQ ID NO:27) confers moderate growth in zeocin to transfected cells in this experiment (FIG. 6). One of the sub-fragments of this STAR, 27B (~500 base pairs, corresponding to approximately the second 500 nucleotides of SEQ ID NO:27), permits weak growth of the host cells in zeocin-containing medium. This suggests that the anti-repression activity of this STAR is partially localized on sub-fragment 27B, but full activity requires sequences from 27A (corresponding to approximately the first 500 nucleotides of SEQ ID NO:27) and/or 27C (corresponding to approximately the third 500 nucleotides of SEQ ID NO:27) (each ~500 base pairs) as well.

Example 7

STAR Elements Function in the Context of Various Transcriptional Promoters

Transgene transcription is achieved by placing the transgene open reading frame under control of an exogenous promoter. The choice of promoter is influenced by the nature of the heterologous protein and the production system. In most cases, strong constitutive promoters are preferred because of the high yields they can provide. Some viral promoters have these properties; the promoter/enhancer of the cytomegalovirus immediate early gene ("CMV promoter") is generally regarded as the strongest promoter in common biotechnological use (Boshart et al., 1985, Doll et al., 1996, Foecking & Hofstetter, 1986). The simian virus SV40 promoter is also moderately strong (Boshart et al., 1985, Foecking & Hofstetter, 1986) and is frequently used for ectopic expression in mammalian cell vectors. The Tet-Off promoter is inducible: the promoter is repressed in the presence of tetracycline or related antibiotics (doxycycline is commonly used) in cell-lines which express the tTA plasmid (Clontech K1620-A), and removal of the antibiotic results in transcriptional induction (Deuschle et al., 1995, Gossen & Bujard, 1992, Izumi & Gilbert, 1999, Umana et al., 1999).

Materials and Methods

The construction of the pSDH-Tet and pSDH-CMV vectors is described in Example 2. pSDH-SV40 was constructed by PCR amplification of the SV40 promoter (primers D41 (SEQ ID NO:142) and D42 (SEQ ID NO:143)) from plasmid pSelect-SV40-Zeo (Example 1), followed by digestion of the PCR product with SacII and SalI. The pSDH-CMV vector was digested with SacII and SalI to remove the CMV promoter, and the vector and SV40 fragment were ligated together to create pSDH-SV40. STAR6 (SEQ ID NO:6) was cloned into MCSI and MCSII as described in Example 2. The plasmids pSDH-Tet, pSDH-Tet-STAR6, pSDH-Tet-STAR7, pSDH-SV40 and pSDH-SV40-STAR6 were co-transfected with pBabe-Puro into U-2 OS using SuperFect® as described by the manufacturer. Cell cultivation, puromycin selection, and luciferase assays were carried out as described in Example 2.

Results

Figure 3:
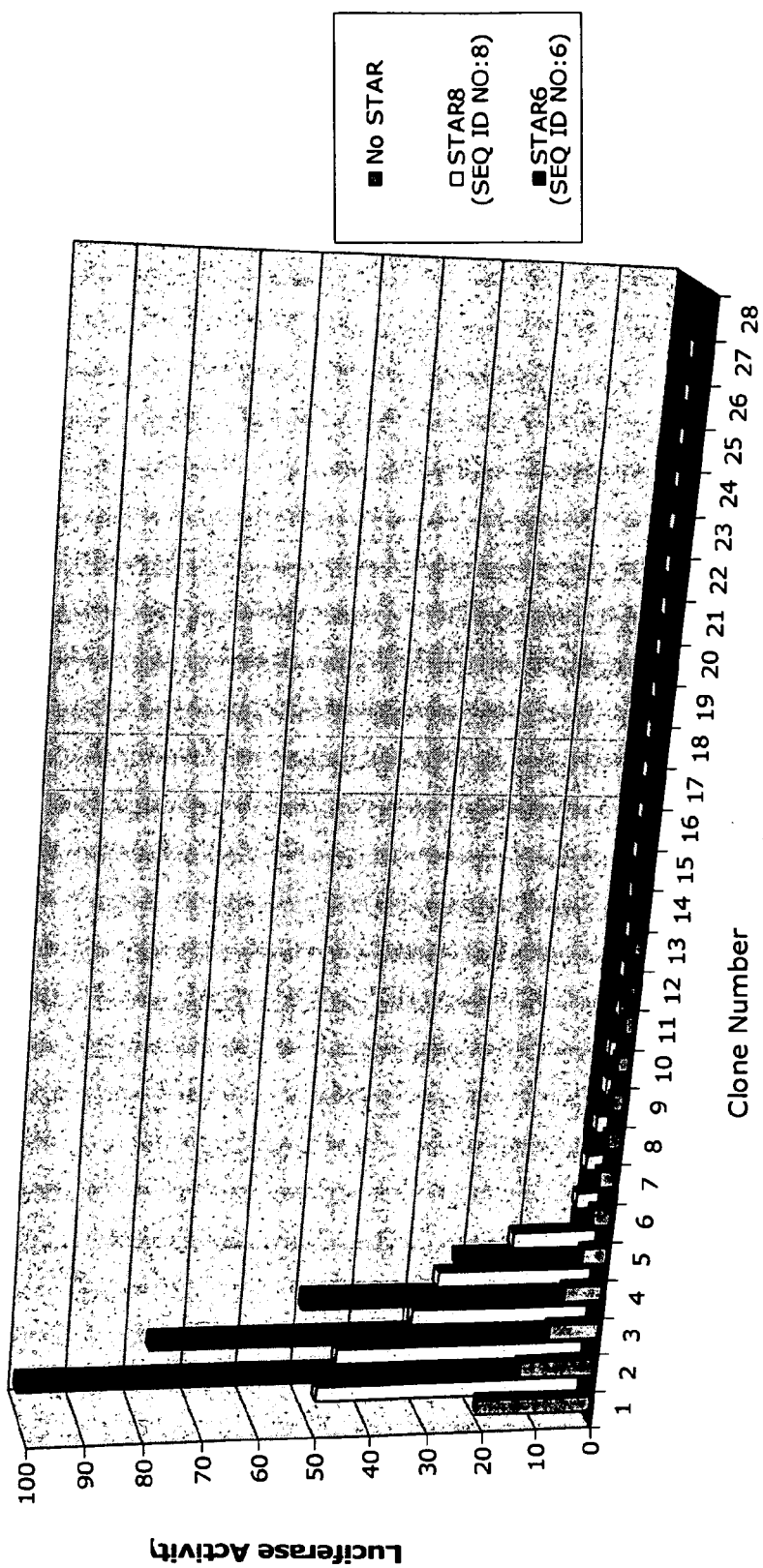
FIG. 3 is a graph showing that STAR6 (SEQ ID NO:6) and STAR8 (SEQ ID NO:8) improve predictability and yield of transgene expression in U-2 OS cells. Expression of luciferase from the CMV promoter by U-2 OS cells transfected with pSDH-CMV, pSDH-CMV-STAR6, or pSDH-CMV-STAR8 was determined. The STAR-containing constructs confer greater predictability and elevated yield relative to the pSDH-CMV construct alone.
Figure 7:
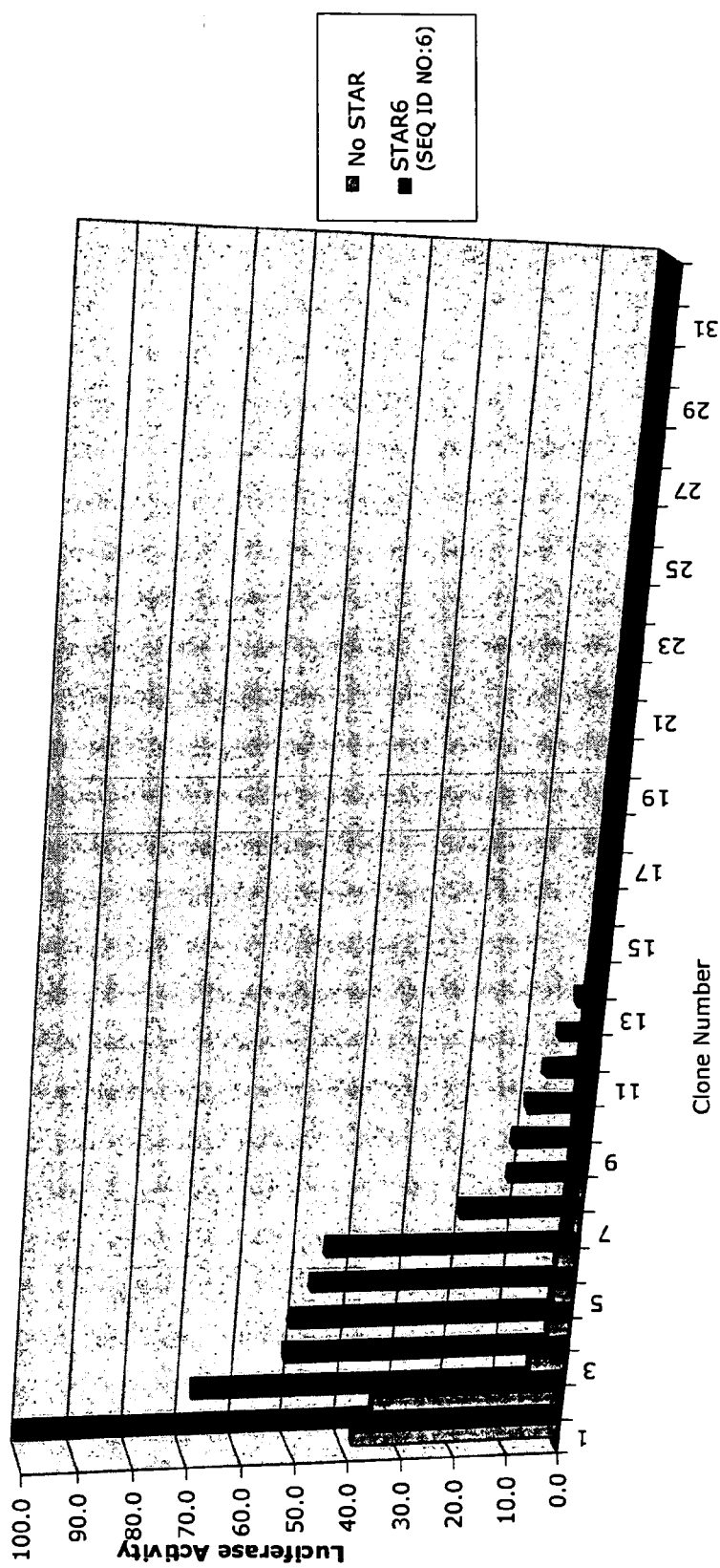
FIG. 7 is a graph illustrating the STAR element function in the context of the SV40 promoter. pSDH-SV40 and pSDH-SV40-STAR6 were transfected into the human osteosarcoma U-2 OS cell line, and expression of luciferase was assayed with or without protection from gene silencing by STAR6 (SEQ ID NO:6) in puromycin-resistant clones.
Figure 8:
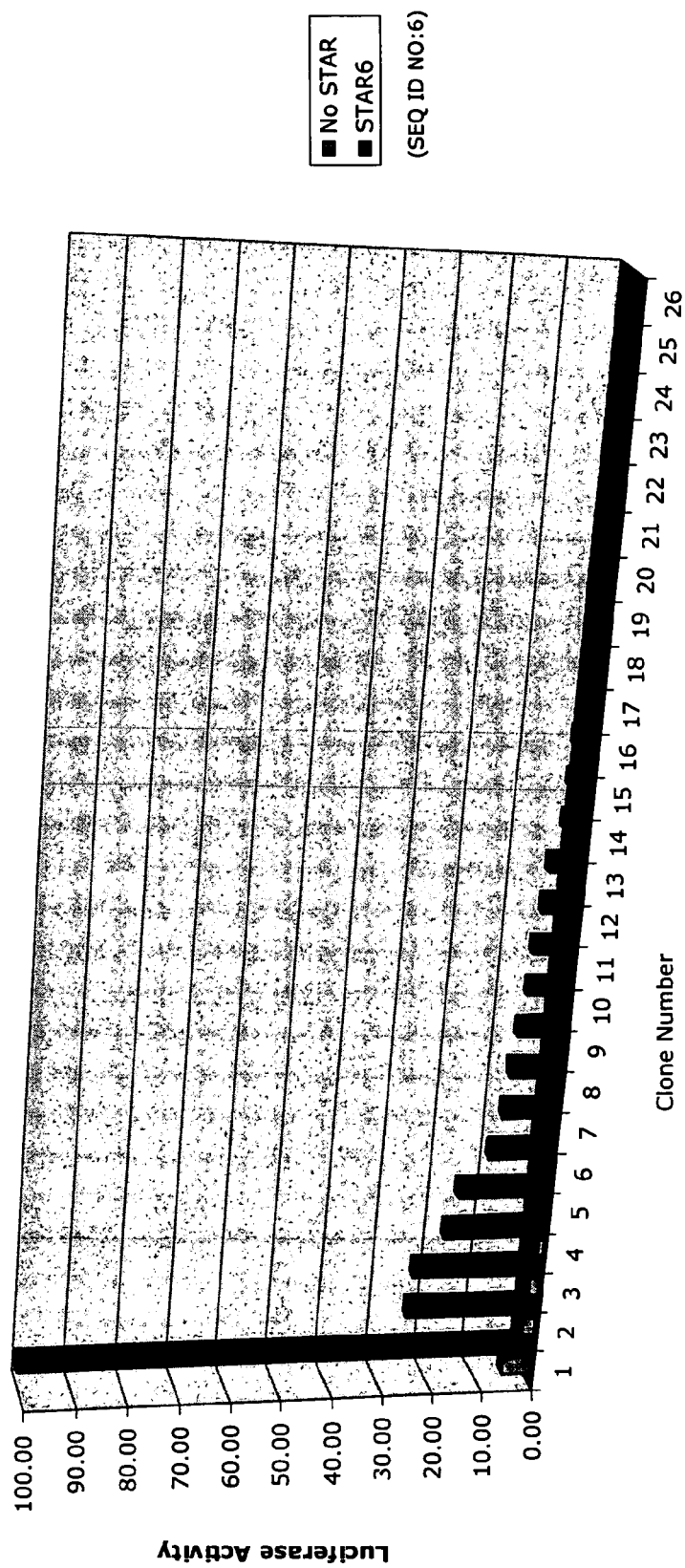
FIG. 8 is a graph showing the STAR element function in the context of the Tet-Off promoter. pSDH-Tet and pSDH-Tet-STAR6 were transfected into the human osteosarcoma U-2 OS cell line, and expression of luciferase was assayed with or without protection from gene silencing by STAR6 (SEQ ID NO:6) in puromycin-resistant clones.

FIGS. 3, 7, and 8 compare the expression of the luciferase reporter gene from three different promoters: two strong and constitutive viral promoters (CMV and SV40), and the inducible Tet-Off promoter. All three promoters were tested in the context of the STAR6 (SEQ ID NO:6) element in U-2 OS cells. The results demonstrate that the yield and predictability from all three promoters are increased by STAR6 (SEQ ID NO:6). As described in Examples 2 and 5, STAR6 (SEQ ID NO:6) is beneficial in the context of the CMV promoter (FIG. 3). Similar improvements are seen in the context of the SV40 promoter (FIG. 7): the yield from the highest-expressing STAR6 clone is two- to three-fold greater than the best pSDH-SV40 clones, and six STAR clones (20% of the population) have yields higher than the best STAR-less clones. In the context of the Tet-Off promoter under inducing (low doxycycline) concentrations, STAR6 (SEQ ID NO:6) also improves the yield and predictability of transgene expression (FIG. 8): the highest-expressing STAR6 clone has a 20-fold higher yield than the best pSDH-Tet clone, and nine STAR6 clones (35% of the population) have yields higher than the best STAR-less clone. It is concluded that this STAR element is versatile in its transgene-protecting properties, since it functions in the context of various biotechnologically useful promoters of transcription.

Example 8

STAR Element Function can be Directional

While short nucleic acid sequences can be symmetrical (e.g., palindromic), longer, naturally-occurring sequences are typically asymmetrical. As a result, the information content of nucleic acid sequences is directional and the sequences themselves can be described with respect to their 5' and 3' ends. The directionality of nucleic acid sequence information affects the arrangement in which recombinant DNA molecules are assembled using standard cloning techniques known in the art (Sambrook et al., 1989). STAR elements are long, asymmetrical DNA sequences, and have a directionality based on the orientation in which they were originally cloned in the pSelect vector. In the examples given above, using two STAR elements in pSDH vectors, this directionality was preserved. This orientation is described as the native or 5'-3' orientation, relative to the zeocin resistance gene (see FIG. 9). In this example the importance of directionality for STAR function is tested in the pSDH-Tet vector. Since the reporter genes in the pSDH vectors are flanked on both sides by copies of the STAR element of interest, the orientation of each STAR copy must be considered. This example compares the native orientation with the opposite orientation (FIG. 9).

Materials and Methods

The STAR66 (SEQ ID NO:66) element was cloned into pSDH-Tet as described in Example 2. U-2 OS cells were co-transfected with plasmids pSDH-Tet-STAR66-native and pSDH-Tet-STAR66-opposite, and cultivated as described in Example 2. Individual clones were isolated and cultivated; the level of luciferase expression was determined as described (supra).

Results

Figure 10:
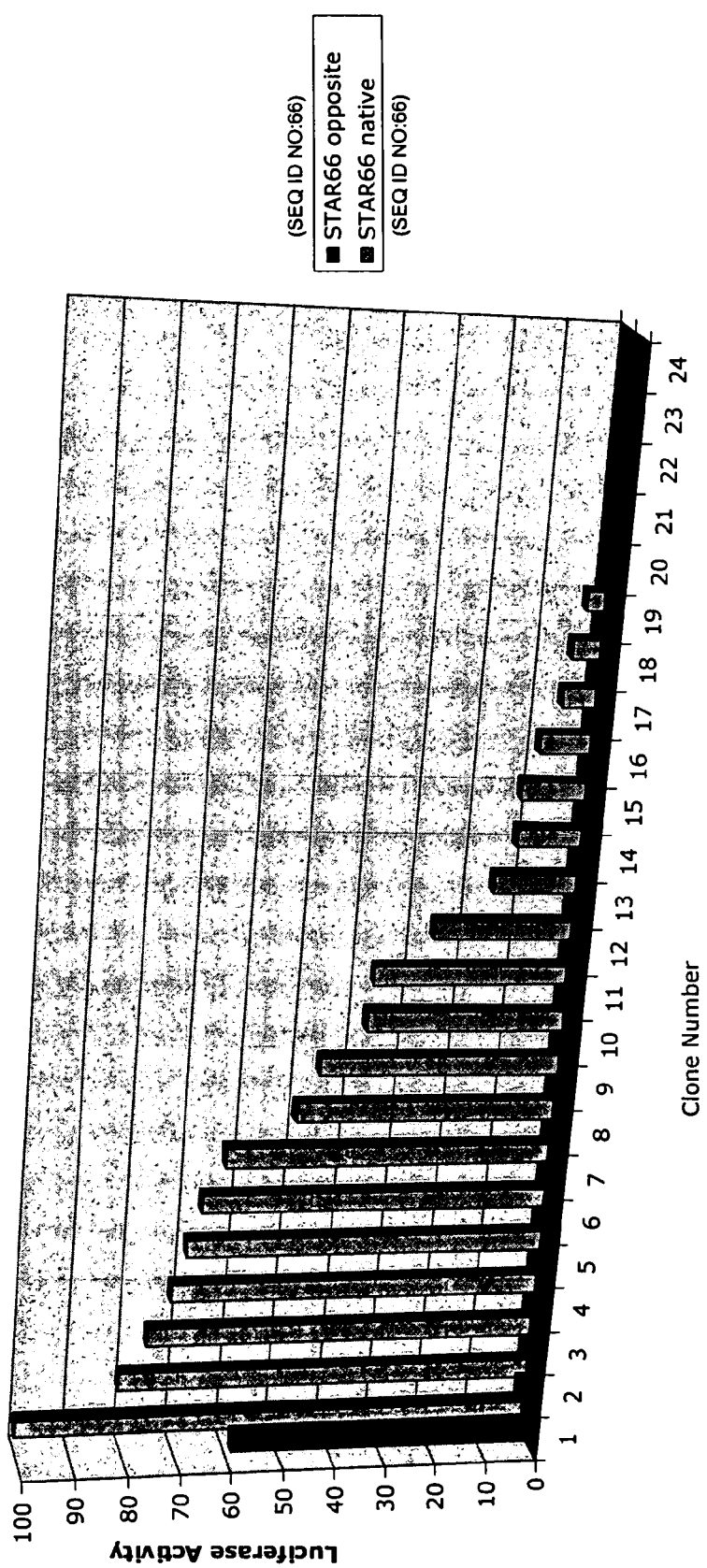
FIG. 10 is a graph showing directionality of STAR66 (SEQ ID NO:66) function. The STAR66 (SEQ ID NO:66) element was cloned into pSDH-Tet in either the native (STAR66 native) or the opposite orientation (STAR66 opposite) and transfected into U-2 OS cells. Luciferase activity was assayed in puromycin resistant clones.

The results of the comparison of STAR66 (SEQ ID NO:66) activity in the native orientation and the opposite orientation are shown in FIG. 10. When STAR66 (SEQ ID NO:66) is in the opposite orientation, the yield of only one clone is reasonably high (60 luciferase units). In contrast, the yield of the highest-expressing clone when STAR66 (SEQ ID NO:66) is in the native orientation is considerably higher (100 luciferase units) and the predictability is much higher, as well: seven clones of the native-orientation population (30%) express luciferase above the level of the highest-expressing clone from the opposite-orientation population, and 15 of the clones in the native-orientation population (60%) express luciferase above ten relative luciferase units. Therefore, it is demonstrated that STAR66 (SEQ ID NO:66) function is directional.

Example 9

Transgene Expression in the Context of STAR Elements is Copy Number-dependent

Transgene expression units for heterologous protein expression are generally integrated into the genome of the host cell to ensure stable retention during cell division. Integration can result in one or multiple copies of the expression unit being inserted into the genome; multiple copies may or may not be present as tandem arrays. The increased yield demonstrated for transgenes protected by STAR elements (supra) suggests that STAR elements are able to permit the transgene expression units to function independently of influences on transcription associated with the site of integration in the genome (independence from position effects (Boivin & Dura, 1998)). It suggests further that the STAR elements permit each expression unit to function independently of neighboring copies of the expression unit when they are integrated as a tandem array (independence from repeat-induced gene silencing (Garrick et al., 1998)). Copy number-dependence is determined from the relationship between transgene expression levels and copy number, as described in the example below.

Materials and Methods

Figure 11:
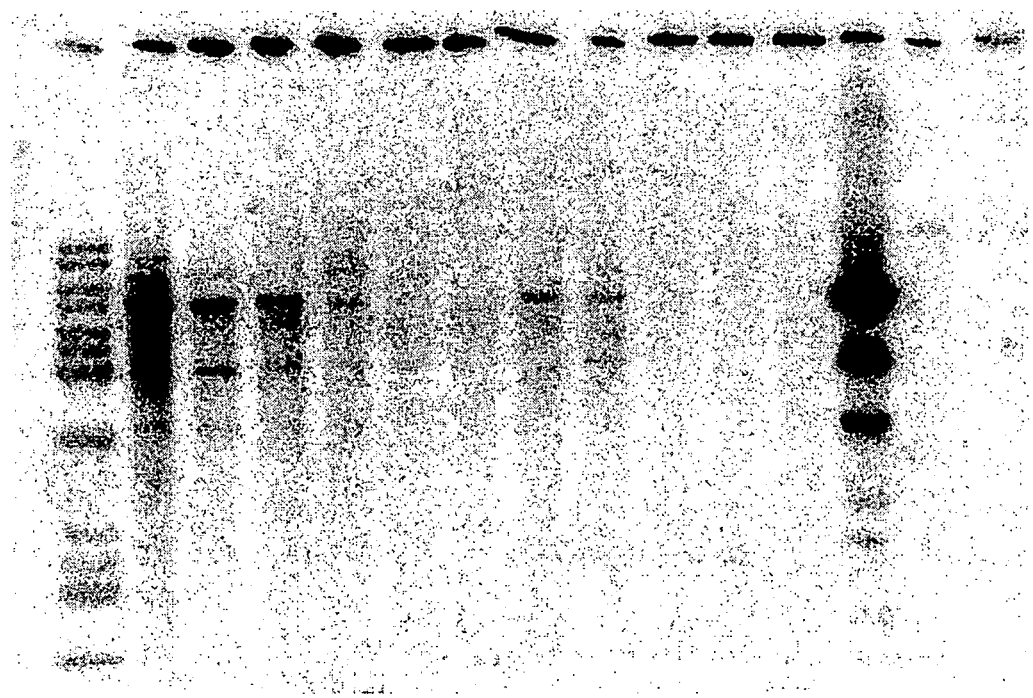
FIG. 11 is a southern blot showing copy number-dependence of STAR function. Southern blot of luciferase expression units in pSDH-Tet-STAR10, integrated into U-2 OS genomic DNA. Radioactive luciferase DNA probe was used to detect the amount of transgene DNA in the genome of each clone, which was then quantified with a phosphorimager.

U-2 OS cells were co-transfected with pSDH-Tet-STAR10 and cultivated under puromycin selection as described (supra). Eight individual clones were isolated and cultivated further. Then cells were harvested, and one portion was assayed for luciferase activity as described (supra). The remaining cells were lysed and the genomic DNA purified using the DNeasy® Tissue Kit (QIAGEN® 69504) as described by the manufacturer. DNA samples were quantitated by UV spectrophotometry. Three micrograms of each genomic DNA sample were digested with PvuII and XhoI overnight as described by the manufacturer (New England Biolabs), and resolved by agarose gel electrophoresis. DNA fragments were transferred to a nylon membrane as described (Sambrook et al., 1989), and hybridized with a radioactively labeled probe to the luciferase gene (isolated from BamHI/SacII-digested pSDH-Tet). The blot was washed as described (Sambrook et al., 1989) and exposed to a phosphorimager screen (Personal F/X, BioRad). The resulting autoradiogram (FIG. 11) was analyzed by densitometry to determine the relative strength of the luciferase DNA bands, which represents the transgene copy number.

Results

Figure 12:
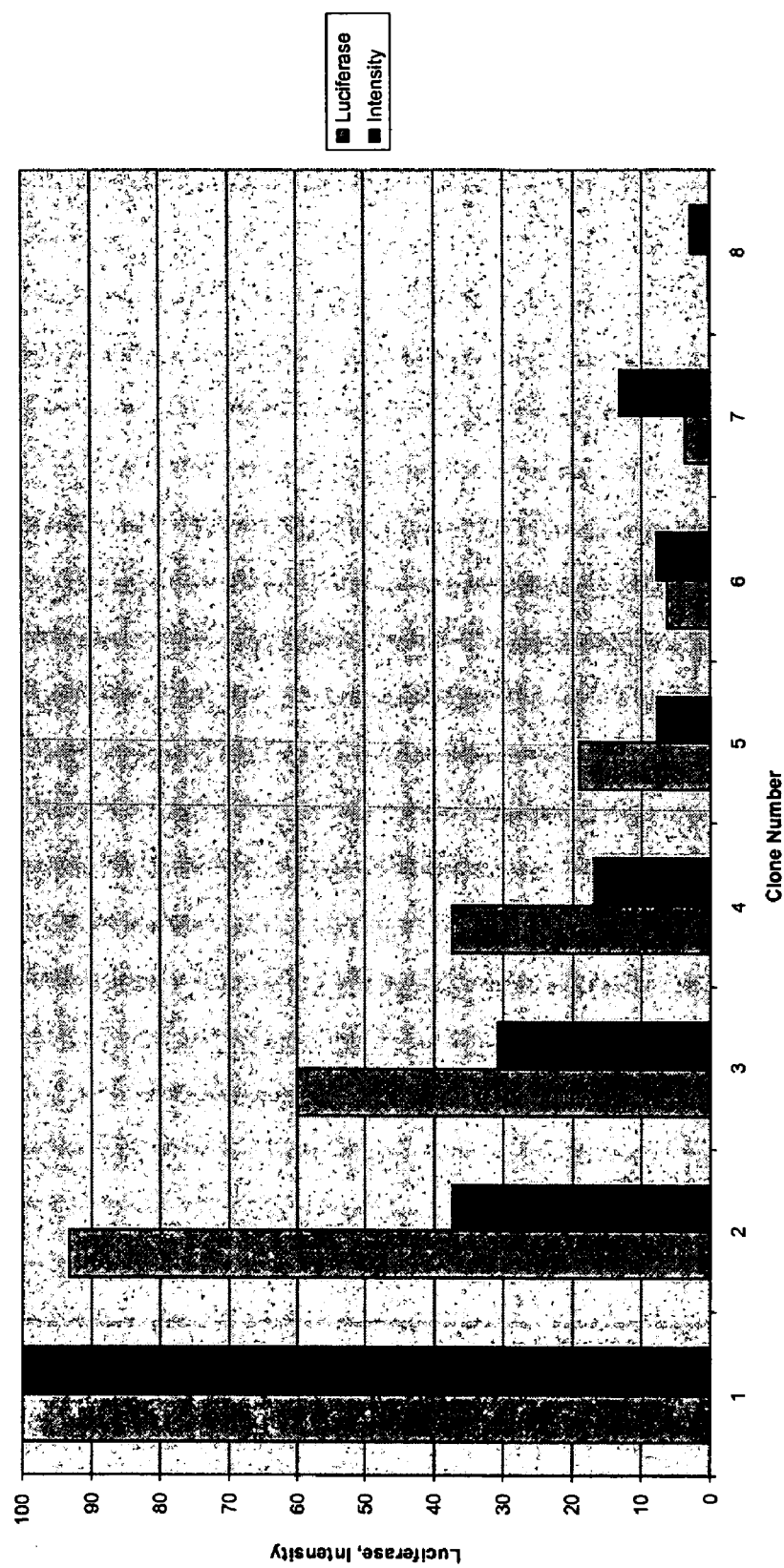
FIG. 12 is a graph illustrating copy number-dependence of STAR function. The copy number of pSDH-Tet-STAR10 expression units in each clone was determined by phosphorimagery and compared with the activity of the luciferase reporter enzyme expressed by each clone.

The enzyme activities and copy numbers (DNA band intensities) of luciferase in the clones from the pSDH-Tet-STAR10 clone population is shown in FIG. 12. The transgene copy number is highly correlated with the level of luciferase expression in these pSDH-Tet-STAR10 clones (r=0.86). This suggests that STAR10 (SEQ ID NO:10) confers copy number-dependence on the transgene expression units, making transgene expression independent of other transgene copies in tandem arrays and independent of gene-silencing influences at the site of integration.

Example 10

STAR Elements Function as Enhancer Blockers but not Enhancers

Gene promoters are subject to both positive and negative influences on their ability to initiate transcription. An important class of elements that exert positive influences are enhancers. Enhancers are characteristically able to affect promoters even when they are located far away (many kilobase pairs) from the promoter. Negative influences that act by heterochromatin formation (e.g., Polycomb group proteins) have been described above, and these are the target of STAR activity. The biochemical basis for enhancer function and for heterochromatin formation is fundamentally similar, since they both involve binding of proteins to DNA. Therefore, it is important to determine whether STAR elements are able to block positive influences as well as negative influences, in other words, to shield transgenes from genomic enhancers in the vicinity of the site of integration. The ability to shield transgenes from enhancer activity ensures stable and predictable performance of transgenes in biotechnological applications. This example examines the performance of STAR elements in an enhancer-blocking assay.

Another feature of STAR activity that is important to their function is the increased yield they confer on transgenes (Example 2). STARs are isolated on the basis of their ability to maintain high levels of zeocin expression when heterochromatin-forming proteins are bound adjacent to the candidate STAR elements. High expression is predicted to occur because STARs are anticipated to block the spread of heterochromatin into the zeocin expression unit. However, a second scenario is that the DNA fragments in zeocin-resistant clones contain enhancers. Enhancers have been demonstrated to have the ability to overcome the repressive effects of Polycomb-group proteins such as those used in the method of the STAR screen (Zink & Paro, 1995). Enhancers isolated by this phenomenon would be considered false positives, since enhancers do not have the properties claimed here for STARs. In order to demonstrate that STAR elements are not enhancers, they have been tested in an enhancer assay.

Figure 13:
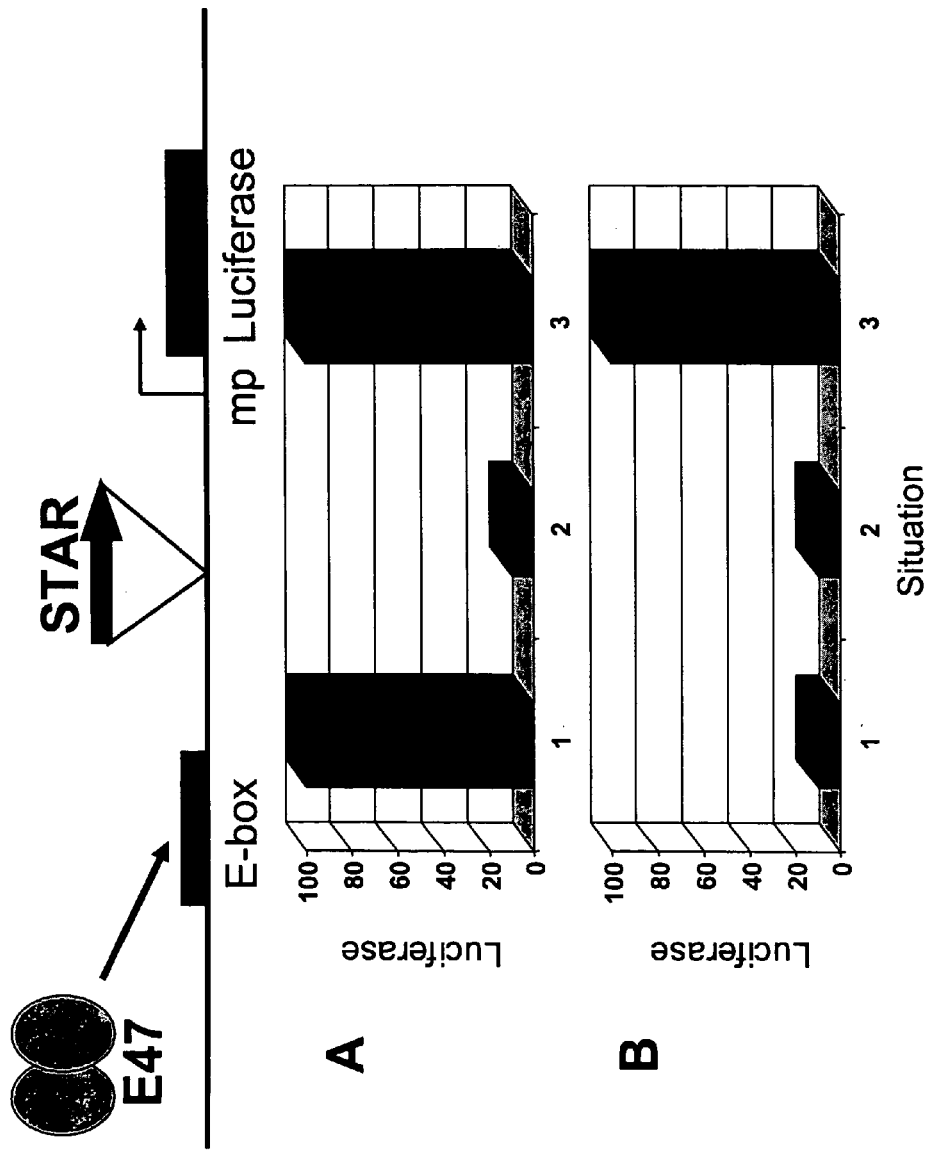
FIG. 13 is a schematic diagram and graphs depicting enhancer-blocking and enhancer assays. The luciferase expression vectors used for testing STARs for enhancer-blocking and enhancer activity are shown schematically. The E-box binding site for the E47 enhancer protein is upstream of a cloning site for STAR elements. Downstream of the STAR cloning site is the luciferase gene under control of a human alkaline phosphatase minimal promoter (mp). The histograms indicate the expected outcomes for the three possible experimental situations (see text). Panel A: Enhancer-blocking assay. Panel B: Enhancer assay.

The enhancer-blocking assay and the enhancer assay are methodologically and conceptually similar. The assays are shown schematically in FIG. 13. The ability of STAR elements to block enhancers is performed using the E47/E-box enhancer system. The E47 protein is able to activate transcription by promoters when it is bound to an E-box DNA sequence located in the vicinity of those promoters (Quong et al., 2002). E47 is normally involved in regulation of B and T lymphocyte differentiation (Quong et al., 2002), but it is able to function in diverse cell types when expressed ectopically (Petersson et al., 2002). The E-box is a palindromic DNA sequence, CANNTG (Knofler et al., 2002). In the enhancer-blocking assay, an E-box is placed upstream of a luciferase reporter gene (including a minimal promoter) in an expression vector. A cloning site for STAR elements is placed between the E-box and the promoter. The E47 protein is encoded on a second plasmid. The assay is performed by transfecting both the E47 plasmid and the luciferase expression vector into cells; the E47 protein is expressed and binds to the E-box, and the E47/E-box complex is able to act as an enhancer. When the luciferase expression vector does not contain a STAR element, the E47/E-box complex enhances luciferase expression (FIG. 13A, situation 1). When STAR elements are inserted between the E-box and the promoter, their ability to block the enhancer is demonstrated by reduced expression of luciferase activity (FIG. 13A, situation 2); if STARs cannot block enhancers, luciferase expression is activated (FIG. 13A, situation 3).

The ability of STAR elements to act as enhancers utilizes the same luciferase expression vector. In the absence of E47, the E-box itself does not affect transcription. Instead, enhancer behavior by STAR elements will result in activation of luciferase transcription. The assay is performed by transfecting the luciferase expression vector without the E47 plasmid. When the expression vector does not contain STAR elements, luciferase expression is low (FIG. 13B, situation 1). If STAR elements do not have enhancer properties, luciferase expression is low when a STAR element is present in the vector (FIG. 13B, situation 2). If STAR elements do have enhancer properties, luciferase expression will be activated in the STAR-containing vectors (FIG. 13B, situation 3).

Materials and Methods

The luciferase expression vector was constructed by inserting the E-box and a human alkaline phosphatase minimal promoter from plasmid mu-E5+E2×6-cat(x) (Ruezinsky et al., 1991) upstream of the luciferase gene in plasmid pGL3-basic (Promega E1751), to create pGL3-E-box-luciferase (gift of W. Romanow). The E47 expression plasmid contains the E47 open reading frame under control of a beta-actin promoter in the pHBAPr-1-neo plasmid; E47 in constitutively expressed from this plasmid (gift of W. Romanow).

STAR elements 1, 2, 3, 6, 10, 11, 18, and 27 (SEQ ID NOS:1, 2, 3, 6, 10, 11, 18, and 27, respectively) have been cloned into the luciferase expression vector. Clones containing the Drosophila scs element and the chicken beta-globin HS4-6× core ("HS4") element have been included as positive controls (they are known to block enhancers, and to have no intrinsic enhancer properties (Chung et al., 1993, Kellum & Schedl, 1992)), and the empty luciferase expression vector has been included as a negative control. All assays were performed using the U-2 OS cell line. In the enhancer-blocking assay, the E47 plasmid was co-transfected with the luciferase expression vectors (empty vector, or containing STAR or positive-control elements). In the enhancer assay, the E47 plasmid was co-transfected with STARless luciferase expression vector as a positive control for enhancer activity; all other samples received a mock plasmid during co-transfection. The transiently transfected cells were assayed for luciferase activity 48 hours after plasmid transfection (supra). The luciferase activity expressed from a plasmid containing no E-box or STAR/control elements was subtracted, and the luciferase activities were normalized to protein content as described (supra).

Results

Figure 14:
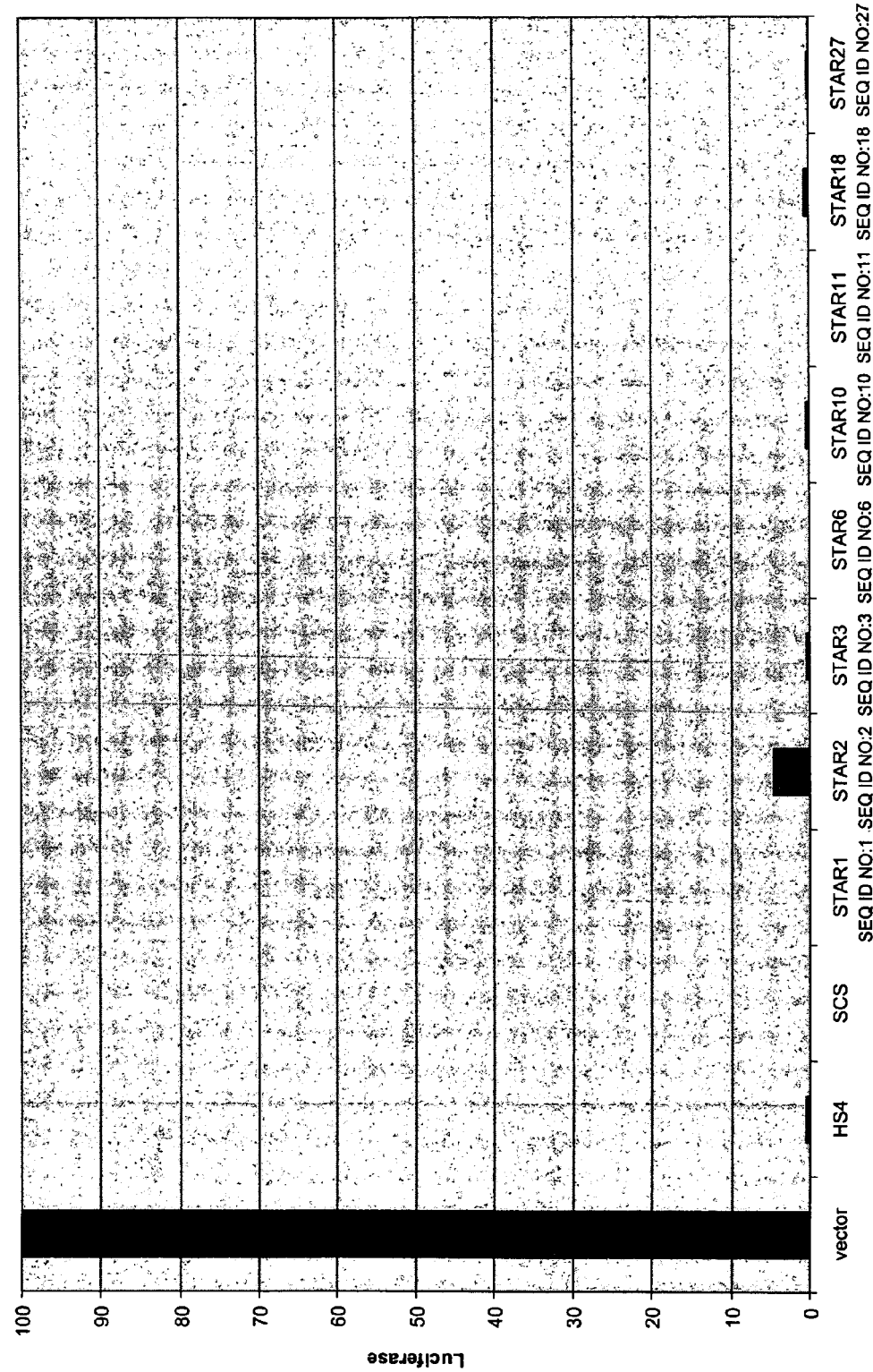
FIG. 14 is a graph showing enhancer-blocking assay. Luciferase expression from a minimal promoter is activated by the E47/E-box enhancer in the empty vector (vector). Insertion of enhancer-blockers (scs, HS4) or STAR elements (STAR elements 1, 2, 3, 6, 10, 11, 18, and 27; SEQ ID NOS:1, 2, 3, 6, 10, 11, 18 and 27, respectively) block luciferase activation by the E47/E-box enhancer.

FIG. 14 shows the results of the enhancer-blocking assay. In the absence of STAR elements (or the known enhancer-blocking elements scs and HS4), the E47/E-box enhancer complex activates expression of luciferase ("vector"); this enhanced level of expression has been normalized to 100. Enhancer activity is blocked by all STAR elements tested. Enhancer activity is also blocked by the HS4 and scs elements, as expected (Bell et al., 2001, Gerasimova & Corces, 2001). These results demonstrate that in addition to their ability to block the spreading of transcriptional silencing (negative influences), STAR elements are able to block the action of enhancers (positive influences).

Figure 15:
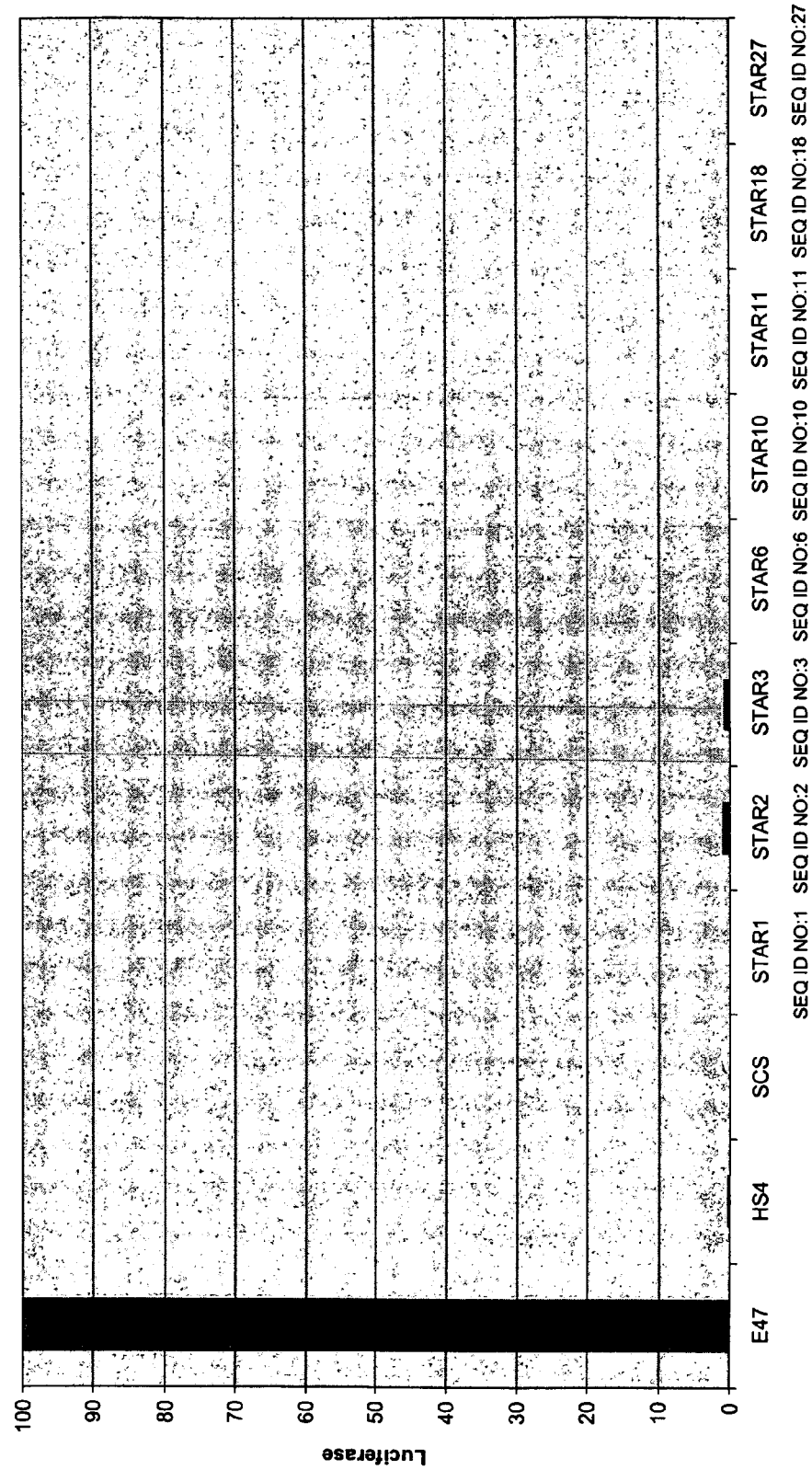
FIG. 15 is a graph illustrating enhancer assay. Luciferase expression from a minimal promoter is activated by the E47/E-box enhancer in the empty vector (E47). Insertion of the scs and HS4 elements or various STAR elements (STARs 1, 2, 3, 6, 10, 11, 18, and 27; SEQ ID NOS:1, 2, 3, 6, 10, 11, 18 and 27, respectively) do not activate transcription of the reporter gene.

FIG. 15 shows the results of the enhancer assay. The level of luciferase expression due to enhancement by the E47/E-box complex is set at 100 ("E47"). By comparison, none of the STAR elements bring about significant activation of luciferase expression. As expected, the scs and HS4 elements also do not bring about activation of the reporter gene. Therefore, it is concluded that at least the tested STAR elements do not possess enhancer properties.

Example 11

STAR Elements are Conserved Between Mouse and Human

BLAT analysis of the STAR DNA sequence against the human genome database (http://genome.ucsc.edu/cgi-bin/hgGateway) reveals that some of these sequences have high sequence conservation with other regions of the human genome. These duplicated regions are candidate STAR elements; if they do show STAR activity, they would be considered paralogs of the cloned STARs (two genes or genetic elements are said to be paralogous if they are derived from a duplication event (Li, 1997)).

BLAST analysis of the human STARs against the mouse genome on the web at ensembl.org/Mus_musculus/blastview) also reveals regions of high sequence conservation between mouse and human. This sequence conservation has been shown for fragments of 15 out of the 65 human STAR elements. The conservation ranges from 64% to 89%, over lengths of 141 base pairs to 909 base pairs (Table 5). These degrees of sequence conservation are remarkable and suggest that these DNA sequences may confer STAR activity within the mouse genome as well. Some of the sequences from the mouse and human genomes in Table 5 could be strictly defined as orthologs (two genes or genetic elements are said to be orthologous if they are derived from a speciation event (Li, 1997)). For example, STAR6 (SEQ ID NO:6) is between the SLC8A1 and HAAO genes in both the human and mouse genomes. In other cases, a cloned human STAR has a paralog within the human genome, and its ortholog has been identified in the mouse genome. For example, STAR3a is a fragment of the 15q11.2 region of human chromosome 15. This region is 96.9% identical (paralogous) with a DNA fragment at 5q33.3 on human chromosome 5, which is near the IL12B interleukin gene. These human DNAs share approximately 80% identity with a fragment of the 11B2 region on mouse chromosome 11. The 11B2 fragment is also near the (mouse) IL12B interleukin gene. Therefore, STAR3a and the mouse 11B2 fragment can be strictly defined as paralogs.

In order to test the hypothesis that STAR activity is shared between regions of high sequence conservation in the mouse and human genome, one of the human STARs with a conserved sequence in mouse, STAR18 (SEQ ID NO:18), has been analyzed in greater detail. The sequence conservation in the mouse genome detected with the original STAR18 clone extends leftward on human chromosome 2 for about 500 base pairs (FIG. 16; left and right relate to the standard description of the arms of chromosome 2). In this example, we examine whether the region of sequence conservation defines a "naturally occurring" STAR element in human that is more extensive in length than the original clone. We also examine whether the STAR function of this STAR element is conserved between mouse and human.

Materials and Methods

The region of mouse/human sequence conservation around STAR18 (SEQ ID NO:18) was recovered from human BAC clone RP11-387A1 by PCR amplification, in three fragments: the entire region (primers E93 (SEQ ID NO:171) and E94 (SEQ ID NO:172)), the leftward half (primers E93 (SEQ ID NO:171) and E92 (SEQ ID NO:170)), and the rightward half (primers E57 (SEQ ID NO:169) and E94 (SEQ ID NO:172)). The corresponding fragments from the homologous mouse region were recovered from BAC clone RP23-400H17 in the same fashion (primers E95 (SEQ ID NO:173) and E98 (SEQ ID NO:176), E95 (SEQ ID NO:173) and E96 (SEQ ID NO:174), and E97 (SEQ ID NO:175) and E98 (SEQ ID NO:176), respectively). All fragments were cloned into the pSelect vector and transfected into a U-2 OS/Tet-Off/LexA-HP1 cell line (supra). Following transfection, hygromycin selection was carried out to select for transfected cells. The LexA-HP1 protein was induced by lowering the doxycycline concentration, and the ability of the transfected cells to withstand the antibiotic zeocin (a measure of STAR activity) was assessed by monitoring cell growth.

Results

Figure 16:
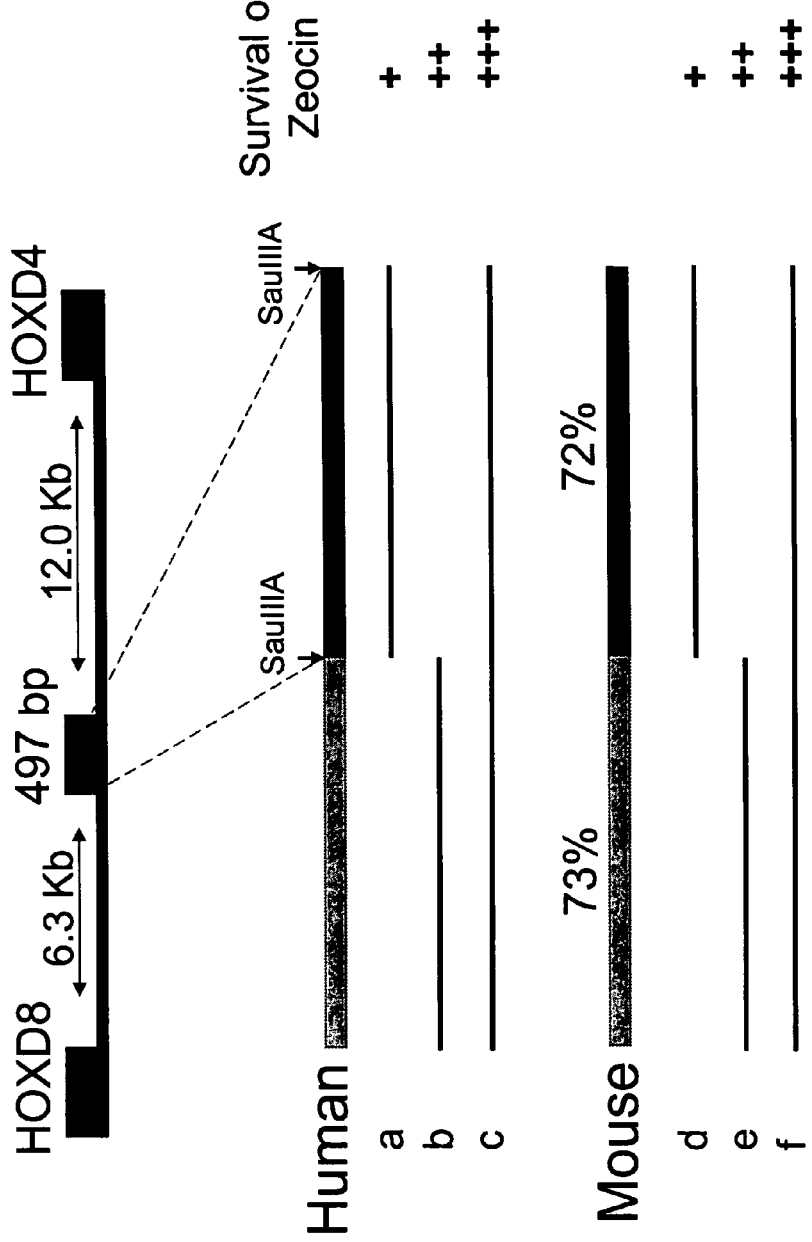
FIG. 16 illustrates STAR18 (SEQ ID NO:18) sequence conservation between mouse and human. The region of the human genome containing 497 base pair STAR 18 (SEQ ID NO:18) is shown (black boxes); the element occurs between the HOXD8 and HOXD4 homeobox genes on human chromosome 2. It is aligned with a region in mouse chromosome 2 that shares 72% sequence identity. The region of human chromosome 2 immediately to the left of STAR18 (SEQ ID NO:18) is also highly conserved with mouse chromosome 2 (73% identity; gray boxes); beyond these region, the identity drops below 60%. The ability of these regions from human and mouse, either separately or in combination, to confer growth on zeocin is indicated: −, no growth; +, moderate growth; ++, vigorous growth; +++, rapid growth.

The original STAR18 clone was isolated from Sau3AI digested human DNA ligated into the pSelect vector on the basis of its ability to prevent silencing of a zeocin resistance gene. Alignment of the human STAR18 clone (497 base pairs) with the mouse genome revealed high sequence similarity (72%) between the orthologous human and mouse STAR18 (SEQ ID NO:18) regions. It also uncovered high similarity (73%) in the region extending for 488 base pairs immediately to the left of the Sau3AI site that defines the left end of the cloned region (FIG. 16). Outside these regions the sequence similarity between human and mouse DNA drops below 60%.

As indicated in FIG. 16, both the human and the mouse STAR18 (SEQ ID NO:18) elements confer survival on zeocin to host cells expressing the lexA-HP1 repressor protein. The original 497 base pair STAR18 clone and its mouse ortholog both confer the ability to grow (FIG. 16, *a* and *d*). The adjacent 488 base pair regions of high similarity from both genomes also confer the ability to grow, and in fact their growth phenotype is more vigorous than that of the original STAR18 clone (FIG. 16, *b* and *e*). When the entire region of sequence similarity was tested, these DNAs from both mouse and human confer growth, and the growth phenotype is more vigorous than the two sub-fragments (FIG. 16, *c* and *f*). These results demonstrate that the STAR activity of human STAR18 (SEQ ID NO:18) is conserved in its ortholog from mouse. The high sequence conservation between these orthologous regions is particularly noteworthy because they are not protein-coding sequences, leading to the conclusion that they have some regulatory function that has prevented their evolutionary divergence through mutation.

This analysis demonstrates that cloned STAR elements identified by the original screening program may in some cases represent partial STAR elements, and that analysis of the genomic DNA in which they are embedded can identify sequences with stronger STAR activity.

Example 12

STAR Elements Contain Characteristic DNA Sequence Motifs

STAR elements are isolated on the basis of their anti-repression phenotype with respect to transgene expression. This anti-repression phenotype reflects underlying biochemical processes that regulate chromatin formation which are associated with the STAR elements. These processes are typically sequence-specific and result from protein binding or DNA structure. This suggests that STAR elements will share DNA sequence similarity. Identification of sequence similarity among STAR elements will provide sequence motifs that are characteristic of the elements that have already been identified by functional screens and tests. The sequence motifs will also be useful to recognize and claim new STAR elements whose functions conform to the claims of this patent. The functions include improved yield and stability of transgenes expressed in eukaryotic host cells.

Other benefits of identifying sequence motifs that characterize STAR elements include: (1) provision of search motifs for prediction and identification of new STAR elements in genome databases, (2) provision of a rationale for modification of the elements, and (3) provision of information for functional analysis of STAR activity. Using bio-informatics, sequence similarities among STAR elements have been identified; the results are presented in this example.

Bio-informatic and Statistical Background

Regulatory DNA elements typically function via interaction with sequence-specific DNA-binding proteins. Bio-informatic analysis of DNA elements, such as STAR elements whose regulatory properties have been identified, but whose interacting proteins are unknown, requires a statistical approach for identification of sequence motifs. This can be achieved by a method that detects short DNA sequence patterns that are over-represented in a set of regulatory DNA elements (e.g., the STAR elements) compared to a reference sequence (e.g., the complete human genome). The method determines the number of observed and expected occurrences of the patterns in each regulatory element. The number of expected occurrences is calculated from the number of observed occurrences of each pattern in the reference sequence.

The DNA sequence patterns can be oligonucleotides of a given length, e.g., six base pairs. In the simplest analysis, for a six-base-pair oligonucleotide (hexamer) composed of the four nucleotides (A, C, G, and T) there are $4^6=4096$ distinct oligonucleotides (all combinations from AAAAAA (SEQ ID NO:121) to TTTTTT (SEQ ID NO:122)). If the regulatory and reference sequences were completely random and had equal proportions of the A, C, G, and T nucleotides, then the expected frequency of each hexamer would be 1/4096 (~0.00024). However, the actual frequency of each hexamer in the reference sequence is typically different than this due to biases in the content of G:C base pairs, etc. Therefore, the frequency of each oligonucleotide in the reference sequence is determined empirically by counting, to create a "frequency table" for the patterns.

The pattern frequency table of the reference sequence is then used to calculate the expected frequency of occurrence of each pattern in the regulatory element set. The expected frequencies are compared with the observed frequencies of occurrence of the patterns. Patterns that are "over-represented" in the set are identified; for example, if the hexamer ACGTGA (SEQ ID NO:123) is expected to occur five times in 20 kilobase pairs of sequence, but is observed to occur 15 times, then it is three-fold over-represented. Ten of the 15 occurrences of that hexameric sequence pattern would not be expected in the regulatory elements if the elements had the same hexamer composition as the entire genome. Once the over-represented patterns are identified, a statistical test is applied to determine whether their over-representation is significant, or may be due to chance. For this test, a significance index, "sig," is calculated for each pattern. The significance index is derived from the probability of occurrence of each pattern, which is estimated by a binomial distribution. The probability takes into account the number of possible patterns (4096 for hexamers). The highest sig values correspond to the most overrepresented oligonucleotides (van Helden et al., 1998). In practical terms, oligonucleotides with sig$\geq$0 are considered as over-represented. A pattern with sig$\geq$0 is likely to be over-represented due to chance once ($=10^0$) in the set of regulatory element sequences. However, at sig$\geq$1 a pattern is expected to be over-represented once in ten ($=10^1$) sequence sets, sig$\geq$2 once in 100 ($=10^2$) sequence sets, etc.

The patterns that are significantly over-represented in the regulatory element set are used to develop a model for classification and prediction of regulatory element sequences. This employs Discriminant Analysis, a so-called "supervised" method of statistical classification known to one of ordinary skill in the art (Huberty, 1994). In Discriminant Analysis, sets of known or classified items (e.g., STAR elements) are used to "train" a model to recognize those items on the basis of specific variables (e.g., sequence patterns such as hexamers). The trained model is then used to predict whether other items should be classified as belonging to the set of known items (e.g., is a DNA sequence a STAR element). In this example, the known items in the training set are STAR elements (positive training set). They are contrasted with sequences that are randomly selected from the genome (negative training set) which have the same length as the STAR elements. Discriminant Analysis establishes criteria for discriminating positives from negatives based on a set of variables that distinguish the positives; in this example, the variables are the significantly over-represented patterns (e.g., hexamers).

When the number of over-represented patterns is high compared to the size of the training set, the model could become biased due to over-training. Over-training is circumvented by applying a forward stepwise selection of variables (Huberty, 1994). The goal of Stepwise Discriminant Analysis is to select the minimum number of variables that provides maximum discrimination between the positives and negatives. The model is trained by evaluating variables one-by-one for their ability to properly classify the items in the positive and negative training sets. This is done until addition of new variables to the model does not significantly increase the model's predictive power (i.e., until the classification error rate is minimized). This optimized model is then used for testing, in order to predict whether "new" items are positives or negatives (Huberty, 1994).

It is inherent in classification statistics that for complex items such as DNA sequences, some elements of the positive training set will be classified as negatives (false negatives), and some members of the negative training set will be classified as positives (false positives). When a trained model is applied to testing new items, the same types of misclassifications are expected to occur.

In the bio-informatic method described here, the first step, Pattern Frequency Analysis, reduces a large set of sequence patterns (e.g., all 4096 hexamers) to a smaller set of significantly over-represented patterns (e.g., 100 hexamers); in the second step, Stepwise Discriminant Analysis reduces the set of over-represented patterns to the subset of those patterns that have maximal discriminative power (e.g., five to ten hexamers). Therefore, this approach provides simple and robust criteria for identifying regulatory DNA elements such as STAR elements.

DNA-binding proteins can be distinguished on the basis of the type of binding site they occupy. Some recognize contiguous sequences; for this type of protein, patterns that are oligonucleotides of length six base pairs (hexamers) are fruitful for bio-informatic analysis (van Helden et al., 1998). Other proteins bind to sequence dyads: contact is made between pairs of highly conserved trinucleotides separated by a non-conserved region of fixed width (van Helden et al., 2000). In order to identify sequences in STAR elements that may be bound by dyad-binding proteins, frequency analysis was also conducted for this type of pattern, where the spacing between the two trinucleotides was varied from 0 to 20 (i.e., XXXN{0-20}XXX where X's are specific nucleotides composing the trinucleotides, and N's are random nucleotides from 0 to 20 base pairs in length). The results of dyad frequency analysis are also used for Linear Discriminant Analysis as described above.

Materials and Methods

Using the genetic screen described in the original patent application, sixty-six (66) STAR elements were initially isolated from human genomic DNA and characterized in detail (Table 3). The screen was performed on gene libraries constructed by Sau3AI digestion of human genomic DNA, either purified from placenta (Clontech 6550-1) or carried in bacterial/P1 (BAC/PAC) artificial chromosomes. The BAC/PAC clones contain genomic DNA from regions of chromosome 1 (clones RP1154H19 and RP3328E19), from the HOX cluster of homeotic genes (clones RP1167F23, RP1170019, and RP11387A1), or from human chromosome 22 (Research Genetics 96010-22). The DNAs were size-fractionated, and the 0.5-2 kb size fraction was ligated into BamHI-digested pSelect vector, by standard techniques (Sambrook et al., 1989). pSelect plasmids containing human genomic DNA that conferred resistance to zeocin at low doxycycline concentrations were isolated and propagated in *Escherichia coli*. The screens that yielded the STAR elements of Table 3 have assayed approximately 1-2% of the human genome.

The human genomic DNA inserts in these 66 plasmids were sequenced by the dideoxy method (Sanger et al., 1977) using a Beckman CEQ™ 2000 automated DNA sequencer, using the manufacturer's instructions. Briefly, DNA was purified from *E. coli* using QIAprep® Spin Miniprep and Plasmid Midi Kits (QIAGEN® 27106 and 12145, respectively). Cycle sequencing was carried out using custom oligonucleotides corresponding to the pSelect vector (primers D89 (SEQ ID NO:149) and D95 (SEQ ID NO:154), Table 2), in the presence of dye terminators (CEQ™ Dye Terminator Cycle Sequencing Kit, Beckman 608000). Assembled STAR DNA sequences were located in the human genome (database builds August and December 2001) using BLAT (Basic Local Alignment Tool (Kent, 2002); on the web at genome.ucsc.edu/cgi-bin/hgGateway; Table 3). In aggregate, the combined STAR sequences comprise 85.6 kilobase pairs, with an average length of 1.3 kilobase pairs.

Figure 17:
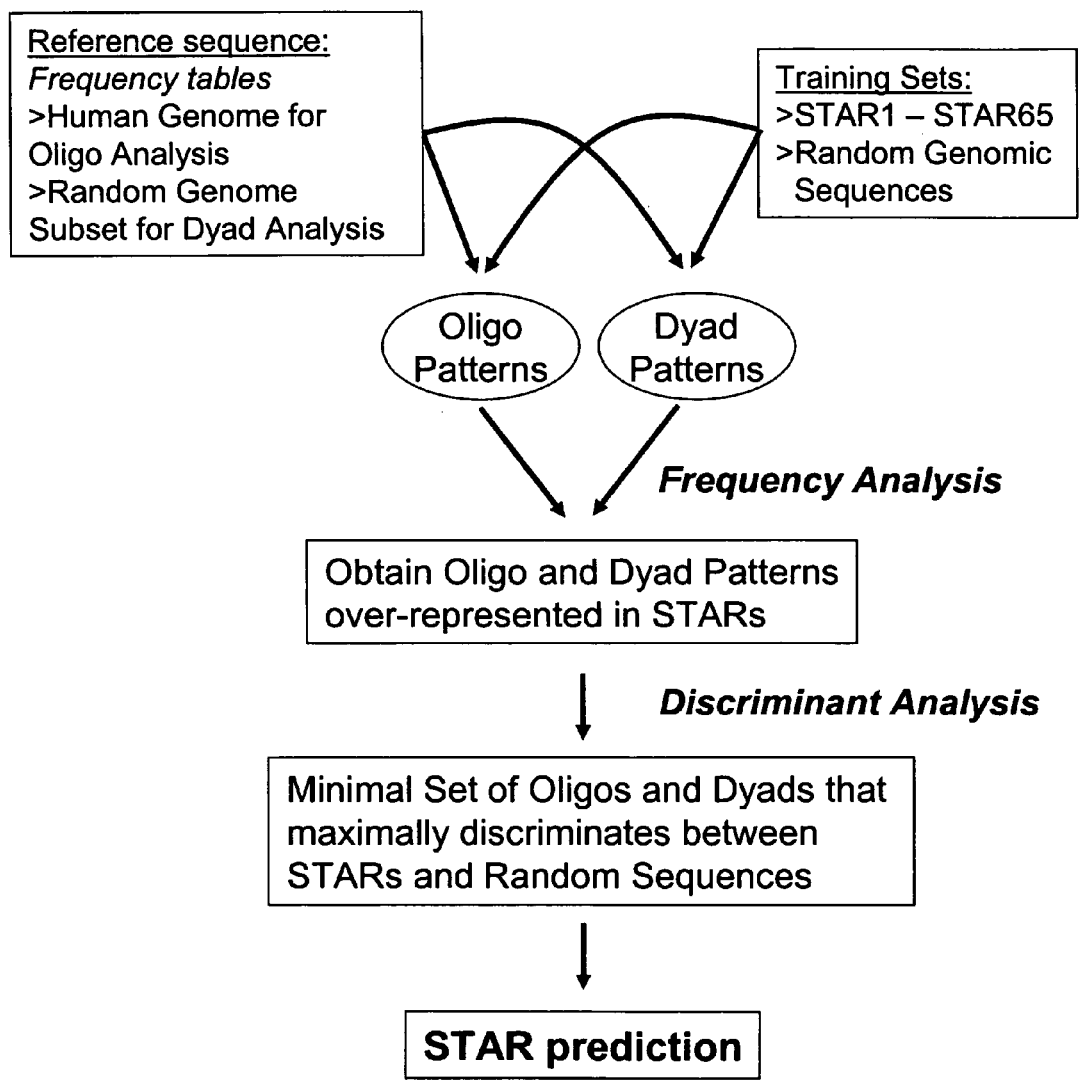
FIG. 17 is a schematic diagram of bio-informatic analysis workflow. For details, see text.

Sequence motifs that distinguish STAR elements within human genomic DNA were identified by bio-informatic analysis using a two-step procedure, as follows (see FIG. 17 for a schematic diagram). The analysis has two input datasets: (1) the DNA sequences of the STAR elements (STAR1-STAR65 (SEQ ID NOS:1-65) were used; Table 3); and (2) the DNA sequence of the human genome (except for chromosome 1, which was not feasible to include due to its large size; for dyad analysis a random subset of human genomic DNA sequence (~27 Mb) was used).

Pattern Frequency Analysis

The first step in the analysis uses RSA-Tools software (Regulatory Sequence Analysis Tools; on the web at ucmb.ulb.ac.be/bioinformatics/rsa-tools/; references (van Helden et al., 1998, van Helden et al., 2000, van Helden et al., 2000)) to determine the following information: (1) the frequencies of all dyads and hexameric oligonucleotides in the human genome; (2) the frequencies of the oligonucleotides and dyads in the 65 STAR elements; and (3) the significance indices of those oligonucleotides and dyads that are over-represented in the STAR elements compared to the genome. A control analysis was done with 65 sequences that were selected at random from the human genome (i.e., from $2689 \times 10^3$ kilobase pairs) that match the length of the STAR elements of Table 3.

Discriminant Analysis

The over-represented oligonucleotides and dyads were used to train models for prediction of STAR elements by Linear Discriminant Analysis (Huberty, 1994). A pre-selection of variables was performed by selecting the 50 patterns with the highest individual discriminatory power from the over-represented oligos or dyads of the frequency analyses. These pre-selected variables were then used for model training in a Stepwise Linear Discriminant Analysis to select the most discriminant combination of variables (Huberty, 1994). Variable selection was based on minimizing the classification error rate (percentage of false negative classifications). In addition, the expected error rate was estimated by applying the same discriminant approach to the control set of random sequences (minimizing the percentage of false positive classifications).

The predictive models from the training phase of Discriminant Analysis were tested in two ways. First, the STAR elements and random sequences that were used to generate the model (the training sets) were classified. Second, sequences in a collection of 19 candidate STAR elements (recently cloned by zeocin selection as described above) were classified. These candidate STAR elements are listed in Table 8 (SEQ ID NOS:66-84).

Results

Pattern frequency analysis was performed with RSA-Tools on 65 STAR elements, using the human genome as the reference sequence. One hundred sixty-six (166) hexameric oligonucleotides were found to be over-represented in the set of STAR elements (sig≧0) compared to the entire genome (Table 6). The most significantly over-represented oligonucleotide, CCCCAC (SEQ ID NO:177), occurs 107 times among the 65 STAR elements, but is expected to occur only 49 times. It has a significance coefficient of 8.76; in other words, the probability that its over-representation is due to random chance is $1/10^{8.76}$, i.e., less than one in 500 million.

Ninety-five of the oligonucleotides have a significance coefficient greater than one, and are, therefore, highly over-represented in the STAR elements. Among the over-represented oligonucleotides, their observed and expected occurrences, respectively, range from 6 and 1 (for oligo 163, CGCGAA (SEQ ID NO:339), sig=0.02) to 133 and 95 (for oligo 120, CCCAGG (SEQ ID NO:296), sig=0.49). The differences in expected occurrences reflect factors such as the G:C content of the human genome. Therefore, the differences among the oligonucleotides in their number of occurrences is less important than their over-representation; for example, oligo 2 (CAGCGG (SEQ ID NO:178)) is 36/9=four-fold over-represented, which has a probability of being due to random chance of one in fifty million (sig=7.75).

Table 6 also presents the number of STAR elements in which each over-represented oligonucleotide is found. For example, the most significant oligonucleotide, oligo 1 (CCCCAC (SEQ ID NO:177)), occurs 107 times, but is found in only 51 STARs, i.e., on average it occurs as two copies per STAR. The least abundant oligonucleotide, number 166 (AATCGG (SEQ ID NO:342)), occurs on average as a single copy per STAR (thirteen occurrences on eleven STARs); single-copy oligonucleotides occur frequently, especially for the lower-abundance oligos. At the other extreme, oligo 4 (CAGCCC (SEQ ID NO:527)) occurs on average three times in those STARs in which it is found (37 STARs). The most widespread oligonucleotide is number 120 (CCCAGG (SEQ ID NO:296)), which occurs on 58 STARs (on average twice per STAR), and the least widespread oligonucleotide is number 114 (CGTCGC (SEQ ID NO:290)), which occurs on only six STARs (and on average only once per STAR).

Results of dyad frequency analysis are given in Table 7. Seven hundred thirty (730) dyads were found to be over-represented in the set of STAR elements (sig≧0) compared to the reference sequence. The most significantly over-represented dyad, CCCN{2}CGG (SEQ ID NO:343), occurs 36 times among the 65 STAR elements, but is expected to occur only seven times. It has a significance coefficient of 9.31; in other words, the probability that its over-representation is due to chance is $1/10^{9.31}$, i.e., less than one in two billion.

Three hundred ninety-seven (397) of the dyads have a significance coefficient greater than 1, and are, therefore, highly over-represented in the STAR elements. Among the over-represented dyads, their observed and expected occurrences, respectively, range from 9 and 1 (for five dyads (numbers 380, 435, 493, 640, and 665)) to 118 and 63 (for number 30 (AGGN{2}GGG (SEQ ID NO:372)), sig=4.44).

The oligonucleotides and dyads found to be over-represented in STAR elements by pattern frequency analysis were tested for their discriminative power by Linear Discriminant Analysis. Discriminant models were trained by step-wise selection of the best combination among the 50 most discriminant oligonucleotide (Table 6) or dyad (Table 7) patterns. The models achieved optimal error rates after incorporation of four (dyad) or five variables. The discriminative variables from oligo analysis are numbers 11, 30, 94, 122, and 160 (Table 6); those from dyad analysis are numbers 73, 194, 419, and 497 (Table 7).

Figure 18:
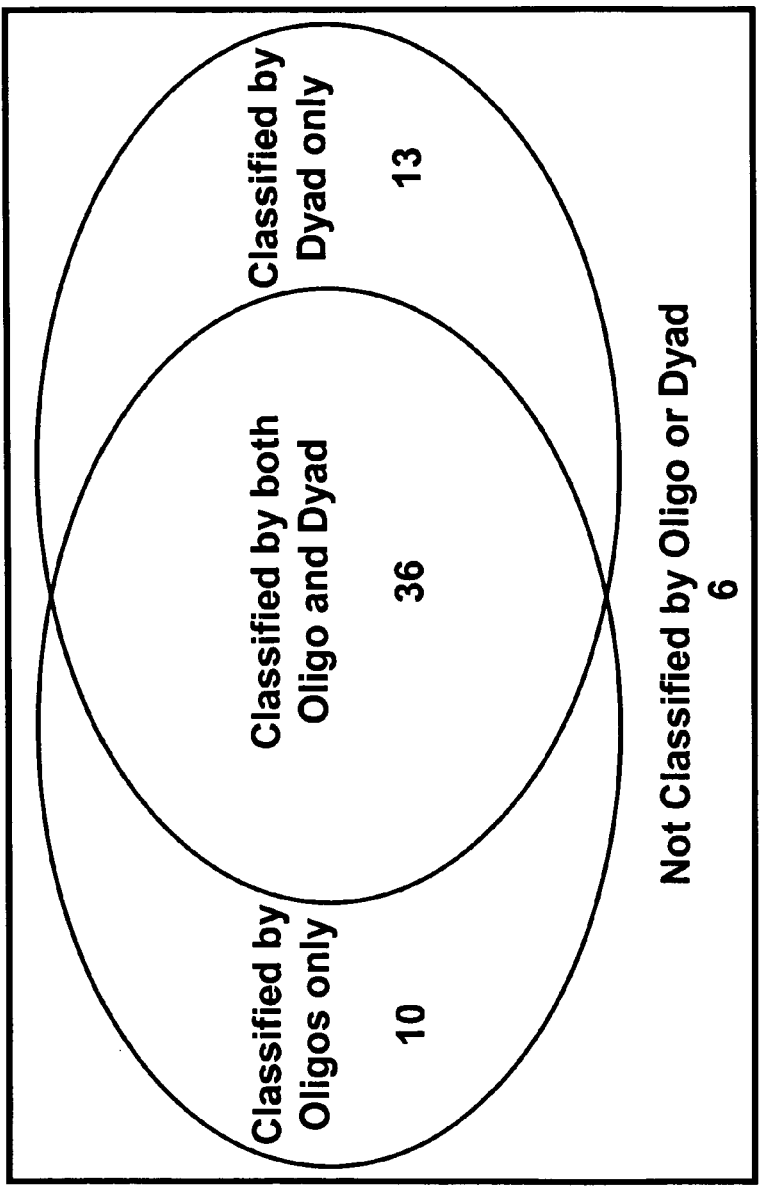
FIG. 18 is a schematic diagram showing the results of discriminant analysis on classification of the training set of 65 STAR elements. STAR elements that are correctly classified as STARs by Stepwise Linear Discriminant Analysis (LDA) are shown in a Venn diagram. The variables for LDA were selected from frequency analysis results for hexameric oligonucleotides ("oligos") and for dyads. The diagram indicates the concordance of the two sets of variables in correctly classifying STARs.

The discriminant models were then used to classify the 65 STAR elements in the training set and their associated random sequences. The model using oligonucleotide variables classifies 46 of the 65 STAR elements as STAR elements (true positives); the dyad model classifies 49 of the STAR elements as true positives. In combination, the models classify 59 of the 65 STAR elements as STAR elements (91%; FIG. 18). The false positive rates (random sequences classified as STARs) were seven for the dyad model, eight for the oligonucleotide model, and 13 for the combined predictions of the two models (20%). The STAR elements of Table 3 that were not classified as STARs by LDA are STAR7, STAR22, STAR35, STAR44, STAR46, and STAR65 (SEQ ID NOS:7, 22, 35, 44, 46 and 65, respectively). These elements display stabilizing anti-repressor activity in functional assays, so the fact that they are not classified as STARs by LDA suggests that they represent another class (or classes) of STAR elements.

The models were then used to classify the 19 candidate STAR elements in the testing set listed in Table 8. The dyad model classifies 12 of these candidate STARs as STAR elements, and the oligonucleotide model classifies 14 as STARs. The combined number of the candidates that are classified as STAR elements is 15 (79%). This is a lower rate of classification than obtained with the training set of 65 STARs; this is expected for two reasons. First, the discriminant models were trained with the 65 STARs of Table 3, and discriminative variables based on this training set may be less well represented in the testing set. Second, the candidate STAR sequences in the testing set have not yet been fully characterized in terms of in vivo function, and may include elements with only weak anti-repression properties.

This analysis demonstrates the power of a statistical approach to bio-informatic classification of STAR elements. The STAR sequences contain a number of dyad and hexameric oligonucleotide patterns that are significantly over-represented in comparison with the human genome as a whole. These patterns may represent binding sites for proteins that confer STAR activity; in any case they form a set of sequence motifs that can be used to recognize STAR element sequences.

Using these patterns to recognize STAR elements by Discriminant Analysis, a high proportion of the elements obtained by the genetic screen of the invention are in fact classified as STARs. This reflects underlying sequence and functional similarities among these elements. An important aspect of the method described here (pattern frequency analysis followed by Discriminant Analysis) is that it can be reiterated; for example, by including the 19 candidate STAR elements of Table 8 with the 66 STAR elements of Table 3 into one training set, an improved discriminant model can be trained. This improved model can then be used to classify other candidate regulatory elements as STARs. Large-scale in vivo screening of genomic sequences using the method of the invention, combined with reiteration of the bio-informatic analysis, will provide a means of discriminating STAR elements that asymptotically approaches 100% recognition and prediction of elements as the genome is screened in its entirety. These stringent and comprehensive predictions of STAR function will ensure that all human STAR elements are recognized, and are available for use in improving transgene expression.

Example 13

Cloning and Characterization of STAR Elements from *Arabidopsis thaliana*

Transgene silencing occurs in transgenic plants at both the transcriptional and post-transcriptional levels (Meyer, 2000, Vance & Vaucheret, 2001). In either case, the desired result of transgene expression can be compromised by silencing; the low expression and instability of the transgene results in poor expression of desirable traits (e.g., pest resistance) or low yields of recombinant proteins. It also results in poor predictability: the proportion of transgenic plants that express the transgene at biotechnologically useful levels is low, which necessitates laborious and expensive screening of transformed individuals for those with beneficial expression characteristics. This example describes the isolation of STAR elements from the genome of the dicot plant *Arabidopsis thaliana* for use in preventing transcriptional transgene silencing in transgenic plants. *Arabidopsis* was chosen for this example because it is a well-studied model organism: it has a compact genome, it is amenable to genetic and recombinant DNA manipulations, and its genome has been sequenced (Bevan et al., 2001, Initiative, 2000, Meinke et al., 1998).

Materials and Methods

Genomic DNA was isolated from *Arabidopsis thaliana* ecotype Columbia as described (Stam et al., 1998) and partially digested with MboI. The digested DNA was size-fractionated to 0.5-2 kilobase pairs by agarose gel electrophoresis and purification from the gel (QIAquick® Gel Extraction Kit, QIAGEN® 28706), followed by ligation into the pSelect vector (supra). Transfection into the U-2 OS/Tet- Off/LexA-HP1 cell line and selection for zeocin resistance at low doxycycline concentration was performed as described (supra). Plasmids were isolated from zeocin resistant colonies and re-transfected into the U-2 OS/Tet-Off/LexA-HP1 cell line.

Sequencing of Arabidopsis genomic DNA fragments that conferred zeocin resistance upon re-transfection was performed as described (supra). The DNA sequences were compared to the sequence of the Arabidopsis genome by BLAST analysis ((Altschul et al., 1990); on the web at URL ncbi.nlm.nih.gov/blast/Blast).

STAR activity was tested further by measuring mRNA levels for the hygromycin- and zeocin-resistance genes in recombinant host cells by reverse transcription PCR (RT-PCR). Cells of the U-2 OS/Tet-Off/lexA-HP1 cell line were transfected with pSelect plasmids containing Arabidopsis STAR elements, the Drosophila scs element, or containing no insert (supra). These were cultivated on hygromycin for two weeks at high doxycycline concentration, then the doxycycline concentration was lowered to 0.1 ng/ml to induce the lexA-HP1 repressor protein. After ten days, total RNA was isolated by the RNeasy® mini kit (QIAGEN® 74104) as described by the manufacturer. First-strand cDNA synthesis was carried out using the RevertAid™ First Strand cDNA Synthesis kit (MBI Fermentas 1622) using oligo(dT) 18 primer as described by the manufacturer. An aliquot of the cDNA was used as the template in a PCR reaction using primers D58 (SEQ ID NO:145) and D80 (SEQ ID NO:148) (for the zeocin marker), and D70 (SEQ ID NO:146) and D71 (SEQ ID NO:147) (for the hygromycin marker), and Taq DNA polymerase (Promega M2661). The reaction conditions were 15-20 cycles of 94° C. for one minute, 54° C. for one minute, and 72° C. for 90 seconds. These conditions result in a linear relationship between input RNA and PCR product DNA. The PCR products were resolved by agarose gel electrophoresis, and the zeocin and hygromycin bands were detected by Southern blotting as described (Sambrook et al., 1989), using PCR products produced as above with purified pSelect plasmid as template. The ratio of the zeocin and hygromycin signals corresponds to the normalized expression level of the zeocin gene.

Results

The library of Arabidopsis genomic DNA in the pSelect vector comprised 69,000 primary clones in E. coli, 80% of which carried inserts. The average insert size was approximately 1000 base pairs; the library, therefore, represents approximately 40% of the Arabidopsis genome.

A portion of this library (representing approximately 16% of the Arabidopsis genome) was transfected into the U-2 OS/Tet-Off/LexA-HP1 cell line. Hygromycin selection was imposed to isolate transfectants, which resulted in 27,000 surviving colonies. These were then subjected to zeocin selection at low doxycycline concentration. Putative STAR-containing plasmids from 56 zeocin-resistant colonies were rescued into E. coli and re-transfected into U-2 OS/Tet-Off/ LexA-HP1 cells. Forty-four of these plasmids (79% of the plasmids tested) conferred zeocin resistance on the host cells at low doxycycline concentrations, demonstrating that the plasmids carried STAR elements. This indicates that the pSelect screen in human U-2 OS cells is highly efficient at detection of STAR elements from plant genomic DNA.

The DNA sequences of these 44 candidate STAR elements were determined. Thirty-five of them were identified as single loci in the database of Arabidopsis nuclear genomic sequence (Table 9; SEQ ID NO:85-SEQ ID NO:119). Four others were identified as coming from the chloroplast genome, four were chimeras of DNA fragments from two loci, and one was not found in the Arabidopsis genome database.

Figure 19:
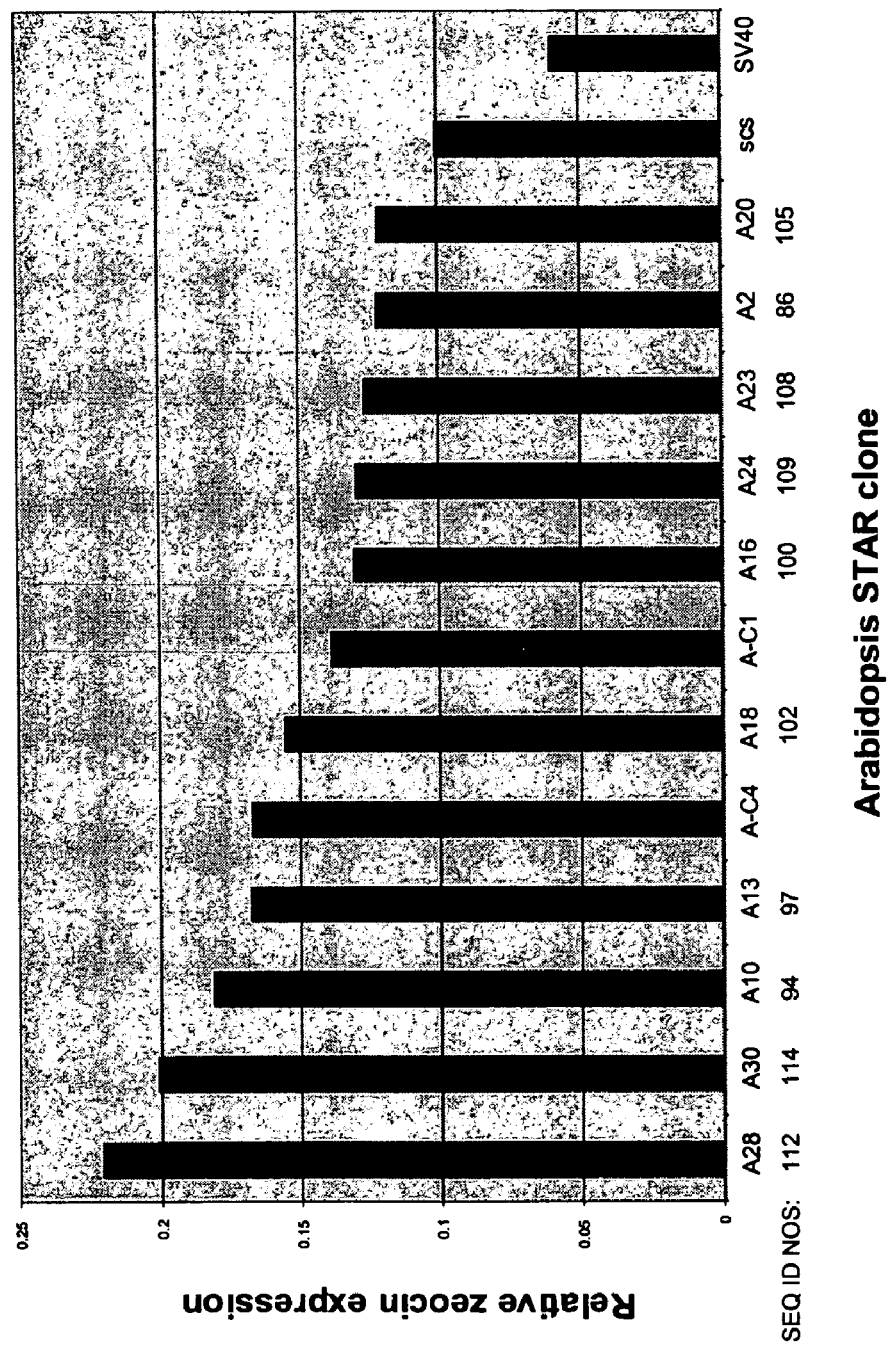
FIG. 19 is a graph illustrating that U-2 OS/Tet-Off/lexA-HP1 cells were transfected with candidate Arabidopsis STAR elements and cultivated at low doxycycline concentrations. Total RNA was isolated and subjected to RT-PCR; the bands corresponding to the zeocin and hygromycin resistance mRNAs were detected by Southern blotting and quantified with a phosphorimager. The ratio of the zeocin to hygromycin signals is shown for transfectants containing zeocin expression units flanked by 12 different Arabidopsis STAR elements, the Drosophila scs element, or no flanking element.

The strength of the cloned Arabidopsis STAR elements was tested by assessing their ability to prevent transcriptional repression of the zeocin-resistance gene, using an RT-PCR assay. As a control for RNA input among the samples, the transcript levels of the hygromycin-resistance gene for each STAR transfection were assessed too. This analysis has been performed for 12 of the Arabidopsis STAR elements. The results (FIG. 19) demonstrate that the Arabidopsis STAR elements are superior to the Drosophila scs element (positive control) and the empty vector ("SV40"; negative control) in their ability to protect the zeocin-resistance gene from transcriptional repression. In particular, STAR-A28 (SEQ ID NO:112) and STAR-A30 (SEQ ID NO:114) enable two-fold higher levels of zeocin-resistance gene expression than the scs element (normalized to the internal control of hygromycin-resistance gene mRNA) when the lexA-HP1 repressor is expressed.

These results demonstrate that the method of the invention can be successfully applied to recovery of STAR elements from genomes of other species than human. Its successful application to STAR elements from a plant genome is particularly significant because it demonstrates the wide taxonomic range over which the method of the invention is applicable and because plants are an important target of biotechnological development.

Example 14

STAR Elements Function in CHO Cells

STAR elements function to block the effect of transcriptional repression influences on transgene expression units. Two of the benefits of STAR elements for heterologous protein production are an increased predictability to find high-expressing primary recombinant host cells as well as increased protein production or yield in these cells. Importantly, the disclosed STAR elements are human DNA sequences, isolated in the human U-2OS osteosarcoma cell line. It is, therefore, an important question whether the human STAR elements are functional in a) cell lines derived from species other than man, and/or in b) human cell lines other than the U-2 OS osteosarcoma cell line. In this example the functionality of STAR 7 (SEQ ID NO:7) in (CHO) Chinese hamster ovary are illustrated.

Material and Methods

Figure 20:
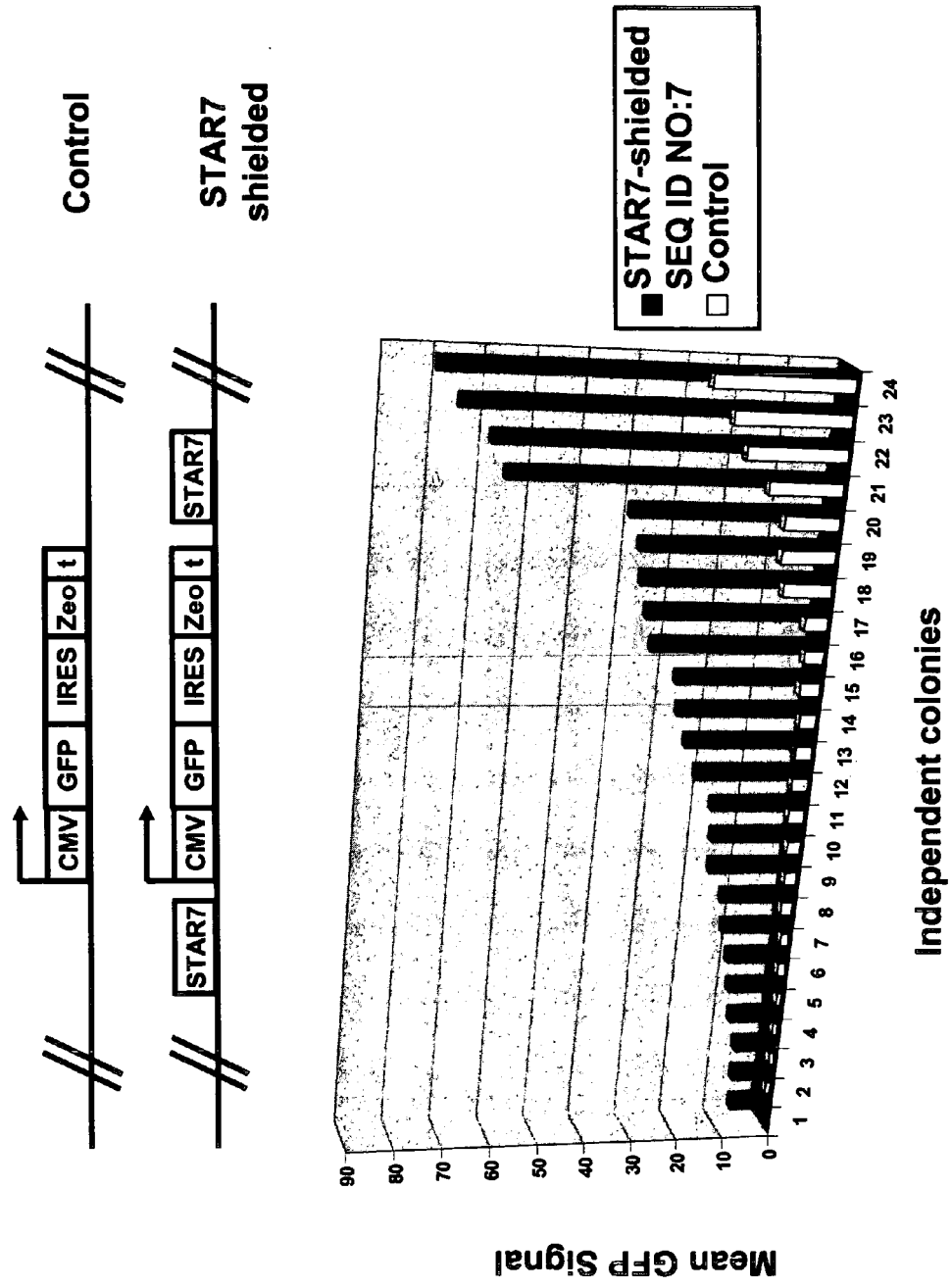
FIG. 20 is a schematic diagram and graph illustrating that STAR elements improve GFP expression in CHO cells. The ppGIZ and ppGIZ-STAR7 plasmids used for testing STAR activity are shown. The expression unit comprises (from 5' to 3') a transgene (encoding for the GFP protein), an IRES, and a selectable marker (zeo, conferring zeocin resistance) under control of the CMV promoter. The expression unit has the SV40 transcriptional terminator at its 3' end (t). The entire cassette with the expression unit is either flanked by STAR7 (SEQ ID NO:7) elements (STAR7-shielded) or not (Control). The constructs are transfected to CHO-K1 cells. Stable colonies are expanded and the GFP signal is determined on a XL-MCL Beckman Coulter flow cytometer. For each independent colony the mean of the GFP signal is plotted. This is taken as measure for the level of GFP expression. The results in FIG. 20 show that in CHO cells the STAR7-shielded construct confers greater predictability and elevated GFP expression relative to the ppGIZ control construct alone.

The STAR7 (SEQ ID NO:7) element is tested in the ppGIZ-STAR7 vector (FIG. 20). The construction of the pPlug&Play-GFP-ires-Zeo (ppGIZ) vector is described below. Plasmid pGFP (Clontech 6010-1) is modified by insertion of a linker at the BsiWI site to yield pGFP-link. The linker (made by annealing oligonucleotides 5' GTACG-GATATCAGATCTTTAATTAAG 3' (SEQ ID NO:124) and 5' GTACCTTAATTAAAGATCTGATATCC 3' (SEQ ID NO:125)) introduces sites for the PacI, BglII, and EcoRV restriction endonucleases. This creates the multiple cloning site MCSII for insertion of STAR elements. Then primers 5' ATCAGATCTGGCGCGCCATTTAAATCGTC TCGCGCGTTTCGGTGATGACGG 3' (SEQ ID NO:126) and 5' AGGCGGATCCGAATG TATTTAGAAAAATAAA-CAAATAGGGG 3' (SEQ ID NO:127) are used to amplify a region of 0.37 kb from pGFP, which is inserted into the BglII site of pIRES (Clontech 6028-1) to yield pIRES-stuf. This introduces sites for the AscI and SwaI restriction endonucleases at MCSI, and acts as a "stuffer fragment" to avoid potential interference between STAR elements and adjacent promoters. pIRES-stuf is digested with BglII and FspI to liberate a DNA fragment composed of the stuffer fragment, the CMV promoter, the IRES element (flanked by multiple cloning sites MCS A and MCS B), and the SV40 polyadenylation signal. This fragment is ligated with the vector backbone of pGFP-link produced by digestion with BamHI and StuI, to yield pIRES-link.

The open reading frames of the zeocin-resistance gene is inserted into the BamHI/NotI sites of MCS B in pIRES-link as follows: the zeocin-resistance ORF is amplified by PCR with primers 5' GATCGGATCCTTCGAAATGGCCAAGT-TGACCAGTGC 3' (SEQ ID NO:128) and 5' AGGCGCG-GCCGCAATTCTCAGTCCTGCTCCTC 3' (SEQ ID NO:129) from plasmid pEM7/zeo, digested with BamHI and NotI, and ligated with BamHI/NotI-digested pIRES-link to yield pIRES-link-zeo. The GFP reporter ORF was introduced into pIRES-link-zeo by amplification of phr-GFP-1 with primers 5' GATCGAATTCTCGCGAATGGTGAG-CAAGCAGATCCTGAAG 3' (SEQID NO:130) and 5' AGGCGAATTCACCGGTGTTTAAACTTA-CACCCACTCGTGCAGGCTGCCCAGG 3' (SEQ ID NO:131), and insertion of the EcoRI-digested GFP cassette into the EcoRI site in MCS A of the pIRES-link-zeo plasmid. This created the ppGIZ (for ppGFP-IRES-zeo). STAR7 (SEQ ID NO:7) is cloned into the SalI site (5') and into the PacI site (3').

Transfection and Culture of CHO Cells

The Chinese Hamster Ovary cell line CHO-K1 (ATCC CCL-61) is cultured in HAMS-F12 medium+10% Fetal Calf Serum containing 2 mM glutamine, 100 U/ml penicillin, and 100 micrograms/ml streptomycin at 37° C./5% $CO_2$. Cells are transfected with the plasmids using Lipofectamine 2000 (Invitrogen) as described by the manufacturer. Briefly, cells are seeded to culture vessels and grown overnight to 70-90% confluence. Lipofectamine reagent is combined with plasmid DNA at a ratio of 7.5 microliters per 3 microgram (e.g., for a 10 cm Petri dish, 20 micrograms DNA and 120 microliters Lipofectamine) and added after a 30-minute incubation at 25° C. to the cells. After a six-hour incubation, the transfection mixture is replaced with fresh medium, and the transfected cells are incubated further. After overnight cultivation, cells are trypsinized and seeded into fresh petri dishes with fresh medium with zeocin added to a concentration of 100 µg/ml and the cells are cultured further. When individual colonies become visible (approximately ten days after transfection) medium is removed and replaced with fresh medium without zeocin. Individual clones are isolated and transferred to 24-well plates in medium with zeocin. Expression of the GFP reporter gene is assessed approximately three weeks after transfection.

The tested constructs consist of a bicistronic gene with the GFP gene, an IRES and the Zeocin resistance gene under control of the CMV promoter, but either with or without STAR7 (SEQ ID NO:7) element to flank the entire construct (FIG. 20). The constructs are transfected to CHO-K1 cells. Stable colonies are expanded before the GFP signal is determined on a XL-MCL Beckman Coulter flow cytometer. The mean of the GFP signal is taken as measure for the level of GFP expression and this is plotted in FIG. 20.

Results

FIG. 20 shows that flanking a GFP reporter gene that is under the control of the CMV promoter results in a higher number of CHO colonies that express significantly higher levels of GFP protein, as compared to the control without STAR7 (SEQ ID NO:7) element. The STAR7 (SEQ ID NO:7) element, therefore, conveys a higher degree of predictability of transgene expression in CHO cells. The highest GFP expression level in STAR-shielded CHO colonies is also higher than in STAR-less control colonies. In addition, when the tested colonies were further grown for another 30 days without Zeocin in the culture medium, the GFP expression levels in the STAR-shielded colonies remained equally high, whereas the GFP expression levels in the STAR-less colonies dropped to at least below 50% of the original values. It is, therefore, concluded that STAR7 (SEQ ID NO:7) is able to convey higher as well as more stable expression levels to a transgene in CHO cells, this being a cell line derived from another species than man.

Example 15

STAR Elements Function in NSO Cells

STAR elements function to block the effect of transcriptional repression influences on transgene expression units. Two of the benefits of STAR elements for heterologous protein production are an increased predictability to find high-expressing primary recombinant host cells, as well as increased protein production or yield in these cells. Importantly, the disclosed STAR elements are human DNA sequences, isolated in the human U-2OS osteosarcoma cell line. It is, therefore, an important question whether the human STAR elements are functional in a) cell lines derived from species other than man, and/or in b) human cell lines other than the U-2 OS osteosarcoma cell line. In this example the functionality of STAR 7 (SEQ ID NO:7) in non-secreting mouse myeloma (NSO) cells are illustrated.

Materials and Methods

The tested constructs are the same as described in Example 14. NSO (Non-Secreting mouse myeloma) cells (ECACC 85110503) are suspension cells that are cultured in RPMI 1640 medium+10% Fetal Calf Serum containing 2 mM glutamine, 100 U/ml penicillin, and 100 micrograms/ml streptomycin at 37° C./5% $CO_2$. Cells are transfected with the plasmids using Lipofectamine 2000 (Invitrogen) as described by the manufacturer. Briefly, cells are seeded to culture vessels and grown overnight to $4 \times 10^5$/ml. Lipofectamine reagent is combined with plasmid DNA at a ratio of 3 microliters per microgram DNA (e.g., for a 10 cm Petri dish, 20 micrograms DNA and 60 microliters Lipofectamine) and added after 30 minutes incubation at 25° C. temperature to the cells. After overnight incubation, the transfection mixture is replaced with fresh medium and the transfected cells are incubated further. After another overnight incubation, zeocin is added to a concentration of 100 µg/ml and the cells are cultured and further incubated for three days. Then the cells are seeded in 96-wells plates in such dilutions that one well will contain ~1 cell. After ten days growing colonies are transferred to 24-well plates.

Results

Figure 21:
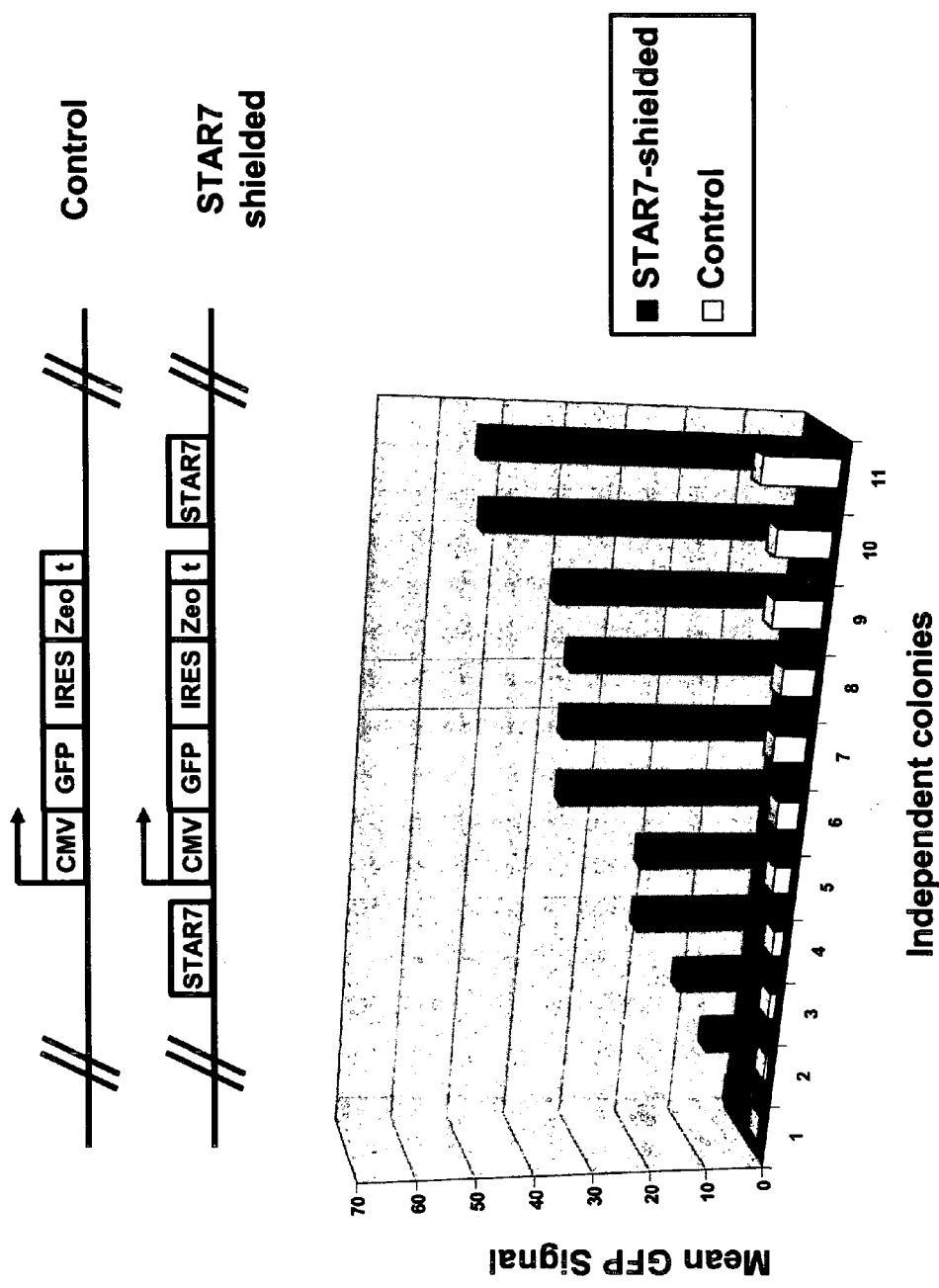
FIG. 21 is a schematic diagram and graph showing that STAR elements improve GFP expression in NSO cells. The ppGIZ and ppGIZ-STAR7 plasmids used for testing STAR activity are shown as in FIG. 20. The constructs are transfected to NSO cells. Stable colonies are expanded and the GFP signal is determined on a XL-MCL Beckman Coulter flow cytometer. For each independent colony the mean of the GFP signal is plotted. This is taken as measure for the level of GFP expression. The results in FIG. 21 show that in NSO cells the STAR7-shielded (SEQ ID NO:7) construct confers greater predictability and elevated GFP expression relative to the ppGIZ control construct alone.

FIG. 21 shows that flanking a GFP reporter gene that is under the control of the CMV promoter results in a higher number of NSO colonies that express significantly higher levels of GFP protein, as compared to the control without STAR7 (SEQ ID NO:7) element. The STAR7 (SEQ ID NO:7) element, therefore, conveys a higher degree of predictability of transgene expression in NSO cells. The highest GFP expression level in STAR-shielded NSO colonies is also higher than in STAR-less control colonies. It is, therefore, concluded that STAR7 (SEQ ID NO:7) is able to convey higher expression levels to a transgene in NSO cells, this being a cell line derived from another species than man.

Example 16

STAR Elements Function in Human 293 Cells

STAR elements function to block the effect of transcriptional repression influences on transgene expression units. Two of the benefits of STAR elements for heterologous protein production are an increased predictability to find high-expressing primary recombinant host cells as well as increased protein production or yield in these cells. Importantly, the disclosed STAR elements are human DNA sequences, isolated in the human U-2OS osteosarcoma cell line. It is, therefore, an important question whether the human STAR elements are functional in a) cell lines derived from species other than man, and/or in b) human cell lines other than the U-2 OS osteosarcoma cell line. In this example, the functionality of STAR7 (SEQ ID NO:7) in human 293 cells are illustrated.

Materials and Methods

The tested constructs are the same as described in Example 14. The 293 cell line (ATCC CRL-1573) is derived from human embryonal kidney (immortalized by adenovirus 5 transfection) and is cultured in Dulbecco's Modified Eagle Medium+10% Fetal Calf Serum containing 2 mM glutamine, 100 U/ml penicillin, and 100 micrograms/ml streptomycin at 37° C./5% $CO_2$. Cells are transfected with the plasmids using Lipofectamine 2000 (Invitrogen) as described by the manufacturer. Selection and propagation of the 293 colonies are as described in Example 14 for U-2 OS cells.

Results

Figure 22:
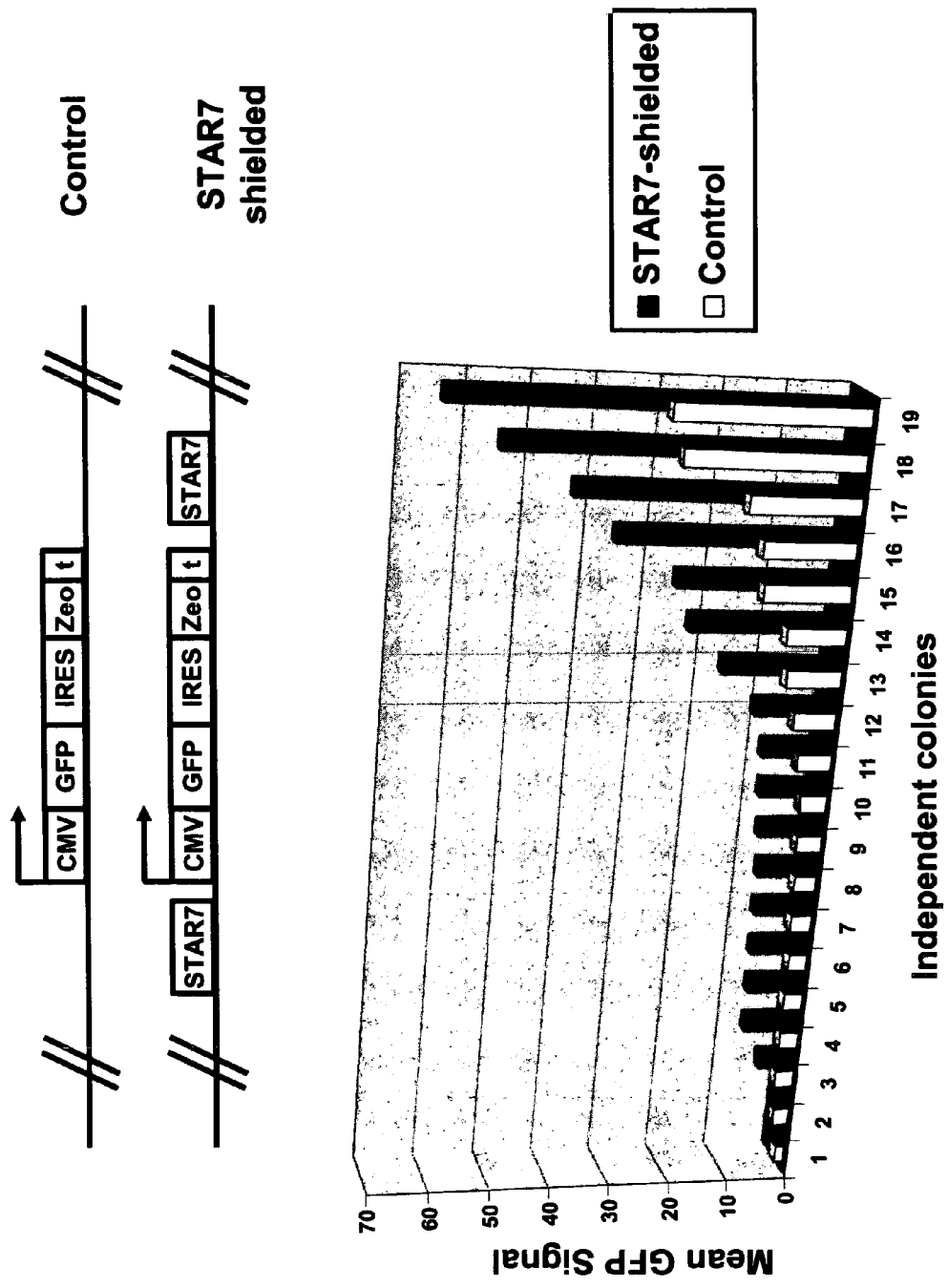
FIG. 22 is a schematic diagram and graph depicting that STAR elements improve GFP expression in 293 cells. The ppGIZ and ppGIZ-STAR7 plasmids used for testing STAR activity are shown as in FIG. 20. The constructs are transfected to 293 cells. Stable colonies are expanded and the GFP signal is determined on a XL-MCL Beckman Coulter flow cytometer. For each independent colony, the mean of the GFP signal is plotted. This is taken as measure for the level of GFP expression. The results in FIG. 22 show that in 293 cells the STAR7-shielded (SEQ ID NO:7) construct confers greater predictability and elevated GFP expression relative to the ppGIZ control construct alone.

FIG. 22 shows that flanking a GFP reporter gene that is under the control of the CMV promoter results in a higher number of 293 colonies that express significantly higher levels of GFP protein, as compared to the control without STAR7 (SEQ ID NO:7) element. The STAR7 (SEQ ID NO:7) element, therefore, conveys a higher degree of predictability of transgene expression in 293 cells. The highest GFP expression level in STAR-shielded colonies is also higher than in STAR-less control colonies. It is, therefore, concluded that STAR7 (SEQ ID NO:7) is able to convey higher expression levels to a transgene in 293 cells, this being another human cell line, distinct from the human U-2 OS cell line.

TABLE 1

Biopharmaceutical Proteins, Their Tissue or Cell Type of Origin

| Protein | Tissue/Somatic Cells | Cell Lines (ATCC #)[1] | Indications |
|---|---|---|---|
| alpha-1 Antitrypsin | Liver, leukocytes | Hep G2 (HB-8065) | Cystic fibrosis, emphysema |
| alpha-Galactosidase A; -Glucosidase | Fibroblasts | WI 38 (CCL-75) | Fabry disease; Pompe's disease |
| Antibodies (monoclonal, single-chain, etc) | Lymphocytes | Transfectomas | Various therapeutic strategies |
| Antithrombin III | Liver | Hep G2 (HB-8065) | Thrombophilia |
| Calcitonin | Thyroid (parafollicular cells) | TT (CRL-1803) | Osteoporosis |
| Ciliary neurotrophic factor | Neural tissue (e.g., astrocytes) | HCN-1A (CRL-10442) | Motor neuron disease |
| Epidermal Growth Factor | Kidney | G-401 (CRL-1441) | Wound healing |
| Erythropoietin | Liver, kidney | Hep G2 (HB-8065), G-401 (CRL-1441) | Anemia |
| Factors VII, VIII, IX | Endothelial cells | HUV-EC-C (CRL-1730) | Hemophilia |
| Famoxin (recombinant gAcrp30) | Adipocytes | NA[2] | Obesity |
| Fibroblast growth factor (basic) | Cerebral cortex, hypothalamus | HCN-1A (CRL-10442) | Wound healing, angiogenesis |
| Gastric lipase | Pancreas | BxPC-3 (CRL-1687) | Pancreatic insufficiency, cystic fibrosis |
| Glucocerebrosidase | Macrophages | U-937 (CRL-1593.2) | Gaucher disease |
| Granulocyte macrophage-colony stimulating factor | T-lymphocytes | J.CaM1.6 (CRL-2063) | Chemotherapy neutropenia |
| Human growth hormone (somatotropin) | Pituitary gland | HP75 (CRL-2506) | Growth retardation, Turner's syndrome |
| Human serum albumin | Liver (hepatocytes) | Hep G2 (HB-8065) | Blood replacement (surgery, burns) |
| Insulin | Pancreas (Islet beta cells) | BxPC-3 (CRL-1687) | Diabetes |
| Interferons alpha | Leukocytes | WBC264-9C (HB-8902) | Cancer, hepatitis C |
| Interferons beta | Fibroblasts | WI 38 (CCL-75) | Multiple sclerosis |
| Interleukin-2, -4, -10 | T-lymphocytes | J.CaM1.6 (CRL-2063) | Cancer, rheumatoid arthritis, hepatitis |
| Interleukin-18 | Monocytes and macrophages | U-937 (CRL-1593.2) | Cancer, bacterial infections |
| Interleukin-1 Receptor Antagonist | Epithelium | HBE4-E6/E7 (CRL-2078) | Rheumatoid arthritis |
| Soluble Tumor Necrosis Factor receptor | Placenta, spleen, fibroblasts | BeWo (CCL-98) | Rheumatoid arthritis, multiple sclerosis |
| van Willebrand's factor | Endothelial cells | HUV-EC-C (CRL-1730) | Hemophilia |

[1]These cell lines are offered only as examples of cultured cells corresponding to the tissues and somatic cells; ATCC #: American Type Culture Collection accession number
[2]NA: Not Available; adipocytes can be differentiated from various other cell types

TABLE 2

Oligonucleotides used for polymerase chain reactions (PCR primers) or DNA mutagenesis (SEQ ID NOS:134-176)

| SEQ ID NO: | Number | Sequence |
|---|---|---|
| 134 | C65 | AACAAGCTTGATATCAGATCTGCTAGCTTGGTCGAGCTGATACTTCCC |
| 135 | C66 | AAACTCGAGCGGCCGCGAATTCGTCGACTTTACCACTCCCTATCAGTGATAGAG |
| 136 | C67 | AAACCGCGGCATGGAAGACGCCAAAAACATAAAGAAAGG |
| 137 | C68 | TATGGATCCTAGAATTACACGGCGATCTTTCC |
| 138 | C81 | AAACCATGGCCGAGTACAAGCCCACGGTGCGCC |
| 139 | C82 | AAATCTAGATCAGGCACCGGGCTTGCGGGTCATGC |
| 140 | C85 | CATTTCCCCGAAAAGTGCCACC |
| 141 | D30 | TCACTGCTAGCGAGTGGTAAACTC |
| 142 | D41 | GAAGTCGACGAGGCAGGCAGAAGTATGC |
| 143 | D42 | GAGCCGCGGTTTAGTTCCTCACCTTGTCG |
| 144 | D51 | TCTGGAAGCTTTGCTGAAGAAAC |
| 145 | D58 | CCAAGTTGACCAGTGCC |
| 146 | D70 | TACAAGCCAACCACGGCCT |
| 147 | D71 | CGGAAGTGCTTGACATTGGG |
| 148 | D80 | GTTCGTGGACACGACCTCCG |
| 149 | D89 | GGGCAAGATGTCGTAGTCAGG |
| 150 | D90 | AGGCCCATGGTCACCTCCATCGCTACTGTG |
| 151 | D91 | CTAATCACTCACTGTGTAAT |
| 152 | D93 | AATTACAGGCGCGCC |
| 153 | D94 | AATTGGCGCGCCTGT |
| 154 | D95 | TGCTTTGCATACTTCTGCCTGCCTC |
| 155 | E12 | TAGGGGGGATCCAAATGTTC |
| 156 | E13 | CCTAAAAGAAGATCTTTAGC |
| 157 | E14 | AAGTGTTGGATCCACTTTGG |
| 158 | E15 | TTTGAAGATCTACCAAATGG |
| 159 | E16 | GTTCGGGATCCACCTGGCCG |
| 160 | E17 | TAGGCAAGATCTTGGCCCTC |
| 161 | E18 | CCTCTCTAGGGATCCGACCC |
| 162 | E19 | CTAGAGAGATCTTCCAGTAT |
| 163 | E20 | AGAGTTCCGGATCCGCCTGG |
| 164 | E21 | CCAGGCAGACTCGGAACTCT |
| 165 | E22 | TGGTGAAACCGGATCCCTAC |
| 166 | E23 | AGGTCAGGAGATCTAGACCA |
| 167 | E25 | CCATTTTCGCTTCCTTAGCTCC |
| 168 | E42 | CGATGTAACCCACTCGTGCACC |
| 169 | E57 | AGAGATCTAGGATAATTTCG |
| 170 | E92 | AGGCGCTAGCACGCGTTCTACTCTTTTCCTACTCTG |

TABLE 2-continued

Oligonucleotides used for polymerase chain reactions (PCR primers) or DNA mutagenesis (SEQ ID NOS:134-176)

| SEQ ID NO: | Number | Sequence |
|---|---|---|
| 171 | E93 | GATCAAGCTTACGCGTCTAAAGGCATTTTATATAG |
| 172 | E94 | AGGCGCTAGCACGCGTTCAGAGTTAGTGATCCAGG |
| 173 | E95 | GATCAAGCTTACGCGTCAGTAAAGGTTTCGTATGG |
| 174 | E96 | AGGCGCTAGCACGCGTTCTACTCTTTCATTACTCTG |
| 175 | E97 | CGAGGAAGCTGGAGAAGGAGAAGCTG |
| 176 | E98 | CAAGGGCCGCAGCTTACACATGTTC |

TABLE 3

STAR elements of the invention, including genomic location and length (SEQ ID NOS: 1-66)

| STAR | SEQ ID NO: | Location[1] | Length |
|---|---|---|---|
| 1 | 1 | 2q31.1 | 750 |
| 2 | 2 | 7p15.2 | 916 |
| 3 | 3 | 15q11.2 and 10q22.2 | 2132 |
| 4 | 4 | 1p31.1 and 14q24.1 | 1625 |
| 5 | 5 | 20q13.32 | 1571 |
| 6 | 6 | 2p21 | 1173 |
| 7 | 7 | 1q34 | 2101 |
| 8 | 8 | 9q32 | 1839 |
| 9 | 9 | 10p15.3 | 1936 |
| 10 | 10 | Xp11.3 | 1167 |
| 11 | 11 | 2p25.1 | 1377 |
| 12 | 12 | 5q35.3 | 1051 |
| 13 | 13 | 9q34.3 | 1291 |
| 14 | 14 | 22q11.22 | 732 |
| 15 | 15 | 1p36.31 | 1881 |
| 16 | 16 | 1p21.2 | 1282 |
| 17 | 17 | 2q31.1 | 793 |
| 18 | 18 | 2q31.3 | 497 |
| 19 | 19 | 6p22.1 | 1840 |
| 20 | 20 | 8p13.3 | 780 |
| 21 | 21 | 6q24.2 | 620 |
| 22 | 22 | 2q12.2 | 1380 |
| 23 | 23 | 6p22.1 | 1246 |
| 24 | 24 | 1q21.2 | 948 |
| 25 | 25 | 1q21.3 | 1067 |
| 26 | 26 | 1q21.1 | 540 |
| 27 | 27 | 1q23.1 | 1520 |
| 28 | 28 | 22q11.23 | 961 |
| 29 | 29 | 2q13.31 | 2253 |
| 30 | 30 | 22q12.3 | 1851 |
| 31 | 31 | 9q34.11 and 22q11.21 | 1165 |
| 32 | 32 | 21q22.2 | 771 |
| 33 | 33 | 21q22.2 | 1368 |
| 34 | 34 | 9q34.14 | 755 |
| 35 | 35 | 7q22.3 | 1211 |
| 36 | 36 | 21q22.2 | 1712 |
| 37 | 37 | 22q11.23 | 1331 |
| 38 | 38 | 22q11.1 and 22q11.1 | ~1000 |
| 39 | 39 | 22q12.3 | 2331 |
| 40 | 40 | 22q11.21 | 1071 |
| 41 | 41 | 22q11.21 | 1144 |
| 42 | 42 | 22q11.1 | 735 |
| 43 | 43 | 14q24.3 | 1231 |
| 44 | 44 | 22q11.1 | 1591 |
| 45 | 45 | 22q11.21 | 1991 |
| 46 | 46 | 22q11.23 | 1871 |
| 47 | 47 | 22q11.21 | 1082 |
| 48 | 48 | 22q11.22 | 1242 |
| 49 | 49 | Chr 12 random clone, and 3q26.32 | 1015 |
| 50 | 50 | 6p21.31 | 2361 |
| 51 | 51 | 5q21.3 | 2289 |
| 52 | 52 | 7p15.2 | 1200 |
| 53 | 53 | Xp11.3 | 1431 |
| 54 | 54 | 4q21.1 | 981 |
| 55 | 55 | 15q13.1 | 501 |
| 56 | 56 | includes 3p25.3 | 741 |
| 57 | 57 | 4q35.2 | 1371 |
| 58 | 58 | 21q11.2 | 1401 |
| 59 | 59 | 17 random clone | 872 |
| 60 | 60 | 4p16.1 and 6q27 | 2068 |
| 61 | 61 | 7p14.3 and 11q25 | 1482 |
| 62 | 62 | 14q24.3 | 1011 |
| 63 | 63 | 22q13.3 | 1421 |
| 64 | 64 | 17q11.2 | 1414 |
| 65 | 65 | 7q21.11 = 28.4 | 1310 |
| 66 | 66 | 20q13.33 and 6q14.1 | ~2800 |

[1]Chromosomal location is determined by BLAST search of DNA sequence data from the STAR elements against the human genome database. The location is given according to standard nomenclature referring to the cytogenetic ideogram of each chromosome; e.g., 1p2.3 is the third cytogenetic sub-band of the second cytogenetic band of the short arm of chromosome 1ncbi.nlm.nih.gov/Class/MLACourse/Genetics/chrombanding.html). F, forward sequencing reaction result; R, reverse sequencing reaction result.

TABLE 4

STAR elements convey stability over time on transgene expression[1]

| | Cell Divisions[2] | Luciferase Expression[3] |
|---|---|---|
| STAR6 (SEQ ID NO: 6) plus puromycin | 42 | 18,000 |
| | 60 | 23,000 |
| | 84 | 20,000 |
| | 108 | 16,000 |

TABLE 4-continued

STAR elements convey stability over time on transgene expression[1]

| | Cell Divisions[2] | Luciferase Expression[3] |
|---|---|---|
| STAR6 (SEQ ID NO: 6) without puromycin[4] | 84 | 12,000 |
| | 108 | 15,000 |
| | 144 | 12,000 |

[1]Plasmid pSDH-Tet-STAR6 was transfected into U-2 OS cells, and clones were isolated and cultivated in doxycycline-free medium as described in Example 1. Cells were transferred to fresh culture vessels weekly at a dilution of 1:20.
[2]The number of cell divisions is based on the estimation that in one week the culture reaches cell confluence, which represents ~6 cell divisions.
[3]Luciferase was assayed as described in Example 1.
[4]After 60 cell divisions the cells were transferred to two culture vessels; one was supplied with culture medium that contained puromycin, as for the first 60 cell divisions, and the second was supplied with culture medium lacking antibiotic.

TABLE 5

Human STAR elements and their putative mouse orthologs and paralogs

| NUMBER | STAR | Human[1] | Mouse[2] | Similarity[3] | SEQ ID NO: |
|---|---|---|---|---|---|
| 1 | 1 | 2q31.1 | 2D | 600 bp 69% | 1 |
| 2 | 2 | 7p15.2 | 6B3 | 909 bp 89% | 2 |
| 3 | 3a | 5q33.3 | 11B2 | 248 bp 83% | 3 |
| 4 | 3b | 10q22.2 | 14B | 1. 363 bp 89% | 3 |
| | | | | 2. 163 bp 86% | |
| 5 | 6 | 2p21 | 17E4 | 437 bp 78% | 6 |
| 6 | 12 | 5q35.3 | 11b1.3 | 796 bp 66% | 12 |
| 7 | 13 | 9q34.3 | 2A3 | 753 bp 77% | 13 |
| 8 | 18 | 2q31.3 | 2E1 | 497 bp 72% | 18 |
| 9 | 36 | 21q22.2 | 16C4 | 166 bp 79% | 36 |
| 10 | 40 | 22q11.1 | 6F1 | 1. 270 bp 75% | 40 |
| | | | | 2. 309 bp 70% | |
| 11 | 50 | 6p21.31 | 17B1 | 1. 451 bp 72% | 50 |
| | | | | 2. 188 bp 80% | |
| | | | | 3. 142 bp 64% | |
| 12 | 52 | 7p15.2 | 6B3 | 1. 846 bp 74% | 52 |
| | | | | 2. 195 bp 71% | |
| 13 | 53 | Xp11.3 | XA2 | 364 bp 64% | 53 |
| 14 | 54 | 4q21.1 | 5E3 | 1. 174 bp 80% | 54 |
| | | | | 2. 240 bp 73% | |
| | | | | 3. 141 bp 67% | |
| | | | | 4. 144 bp 68% | |
| 15 | 61a | 7pl4.3 | 6B3 | 188 bp 68% | 61 |

[1]Cytogenetic location of STAR element in the human genome.
[2]Cytogenetic location of STAR element ortholog in the mouse genome.
[3]Length of region(s) displaying high sequence similarity, and percentage similarity. In some cases more than one block of high similarity occurs; in those cases, each block is described separately. Similarity <60% is not considered significant.

TABLE 6

Oligonucleotide patterns (6 base pairs) over-represented in STAR elements. The patterns are ranked according to significance coefficient. These were determined using RSA-Tools with the sequence of the human genome as reference. Patterns that comprise the most discriminant variables in Linear Discriminant Analysis are indicated with an asterisk. (SEQ ID NOS: 177-342)

| Number | Oligonucleotide sequence | Observed occurrences | Expected occurrences | Significance coefficient | Number of matching STARs | SEQ ID NO: |
|---|---|---|---|---|---|---|
| 1 | CCCCAC | 107 | 49 | 8.76 | 51 | 177 |
| 2 | CAGCGG | 36 | 9 | 7.75 | 23 | 178 |
| 3 | GGCCCC | 74 | 31 | 7.21 | 34 | 179 |
| 4 | CAGCCC | 103 | 50 | 7.18 | 37 | 180 |
| 5 | GCCCCC | 70 | 29 | 6.97 | 34 | 181 |
| 6 | CGGGGC | 40 | 12 | 6.95 | 18 | 182 |
| 7 | CCCCGC | 43 | 13 | 6.79 | 22 | 183 |
| 8 | CGGCAG | 35 | 9 | 6.64 | 18 | 184 |
| 9 | AGCCCC | 83 | 38 | 6.54 | 40 | 185 |
| 10 | CCAGGG | 107 | 54 | 6.52 | 43 | 186 |
| 11 | GGACCC * | 58 | 23 | 6.04 | 35 | 187 |
| 12 | GCGGAC | 20 | 3 | 5.94 | 14 | 188 |
| 13 | CCAGCG | 34 | 10 | 5.9 | 24 | 189 |
| 14 | GCAGCC | 92 | 45 | 5.84 | 43 | 190 |
| 15 | CCGGCA | 28 | 7 | 5.61 | 16 | 191 |
| 16 | AGCGGC | 27 | 7 | 5.45 | 17 | 192 |
| 17 | CAGGGG | 86 | 43 | 5.09 | 43 | 193 |
| 18 | CCGCCC | 43 | 15 | 5.02 | 18 | 194 |
| 19 | CCCCCG | 35 | 11 | 4.91 | 20 | 195 |
| 20 | GCCGCC | 34 | 10 | 4.88 | 18 | 196 |
| 21 | GCCGGC | 22 | 5 | 4.7 | 16 | 197 |
| 22 | CGGACC | 19 | 4 | 4.68 | 14 | 198 |
| 23 | CGCCCC | 35 | 11 | 4.64 | 19 | 199 |

TABLE 6-continued

Oligonucleotide patterns (6 base pairs) over-represented in STAR elements.
The patterns are ranked according to significance coefficient. These were determined
using RSA-Tools with the sequence of the human genome as reference. Patterns
that comprise the most discriminant variables in Linear Discriminant Analysis
are indicated with an asterisk. (SEQ ID NOS: 177-342)

| Number | Oligonucleotide sequence | Observed occurrences | Expected occurrences | Significance coefficient | Number of matching STARs | SEQ ID NO: |
|---|---|---|---|---|---|---|
| 24 | CGCCAG | 28 | 8 | 4.31 | 19 | 200 |
| 25 | CGCAGC | 29 | 8 | 4.29 | 20 | 201 |
| 26 | CAGCCG | 32 | 10 | 4 | 24 | 202 |
| 27 | CCCACG | 33 | 11 | 3.97 | 26 | 203 |
| 28 | GCTGCC | 78 | 40 | 3.9 | 43 | 204 |
| 29 | CCCTCC | 106 | 60 | 3.87 | 48 | 205 |
| 30 | CCCTGC * | 92 | 50 | 3.83 | 42 | 206 |
| 31 | CACCCC | 77 | 40 | 3.75 | 40 | 207 |
| 32 | GCGCCA | 30 | 10 | 3.58 | 23 | 208 |
| 33 | AGGGGC | 70 | 35 | 3.55 | 34 | 209 |
| 34 | GAGGGC | 66 | 32 | 3.5 | 40 | 210 |
| 35 | GCGAAC | 14 | 2 | 3.37 | 13 | 211 |
| 36 | CCGGCG | 17 | 4 | 3.33 | 12 | 212 |
| 37 | AGCCGG | 34 | 12 | 3.29 | 25 | 213 |
| 38 | GGAGCC | 67 | 34 | 3.27 | 40 | 214 |
| 39 | CCCCAG | 103 | 60 | 3.23 | 51 | 215 |
| 40 | CCGCTC | 24 | 7 | 3.19 | 19 | 216 |
| 41 | CCCCTC | 81 | 44 | 3.19 | 43 | 217 |
| 42 | CACCGC | 33 | 12 | 3.14 | 22 | 218 |
| 43 | CTGCCC | 96 | 55 | 3.01 | 42 | 219 |
| 44 | GGGCCA | 68 | 35 | 2.99 | 39 | 220 |
| 45 | CGCTGC | 28 | 9 | 2.88 | 22 | 221 |
| 46 | CAGCGC | 25 | 8 | 2.77 | 19 | 222 |
| 47 | CGGCCC | 28 | 10 | 2.73 | 19 | 223 |
| 48 | CCGCCG | 19 | 5 | 2.56 | 9 | 224 |
| 49 | CCCCGG | 30 | 11 | 2.41 | 17 | 225 |
| 50 | AGCCGC | 23 | 7 | 2.34 | 17 | 226 |
| 51 | GCACCC | 55 | 27 | 2.31 | 38 | 227 |
| 52 | AGGACC | 54 | 27 | 2.22 | 33 | 228 |
| 53 | AGGGCG | 24 | 8 | 2.2 | 18 | 229 |
| 54 | CAGGGC | 81 | 47 | 2.18 | 42 | 230 |
| 55 | CCCGCC | 45 | 21 | 2.15 | 20 | 231 |
| 56 | GCCAGC | 66 | 36 | 2.09 | 39 | 232 |
| 57 | AGCGCC | 21 | 6 | 2.09 | 18 | 233 |
| 58 | AGGCCC | 64 | 34 | 2.08 | 32 | 234 |
| 59 | CCCACC | 101 | 62 | 2.05 | 54 | 235 |
| 60 | CGCTCA | 21 | 6 | 2.03 | 17 | 236 |
| 61 | AACGCG | 9 | 1 | 1.96 | 9 | 237 |
| 62 | GCGGCA | 21 | 7 | 1.92 | 14 | 238 |
| 63 | AGGTCC | 49 | 24 | 1.87 | 36 | 239 |
| 64 | CCGTCA | 19 | 6 | 1.78 | 14 | 240 |
| 65 | CAGAGG | 107 | 68 | 1.77 | 47 | 241 |
| 66 | CCCGAG | 33 | 14 | 1.77 | 22 | 242 |
| 67 | CCGAGG | 36 | 16 | 1.76 | 25 | 243 |
| 68 | CGCGGA | 11 | 2 | 1.75 | 8 | 244 |
| 69 | CCACCC | 87 | 53 | 1.71 | 45 | 245 |
| 70 | CCTCGC | 23 | 8 | 1.71 | 20 | 246 |
| 71 | CAAGCC | 59 | 32 | 1.69 | 40 | 247 |
| 72 | TCCGCA | 18 | 5 | 1.68 | 17 | 248 |
| 73 | CGCCGC | 18 | 5 | 1.67 | 9 | 249 |
| 74 | GGGAAC | 55 | 29 | 1.63 | 39 | 250 |
| 75 | CCAGAG | 93 | 58 | 1.57 | 49 | 251 |
| 76 | CGTTCC | 19 | 6 | 1.53 | 16 | 252 |
| 77 | CGAGGA | 23 | 8 | 1.5 | 19 | 253 |
| 78 | GGGACC | 48 | 24 | 1.48 | 31 | 254 |
| 79 | CCGCGA | 10 | 2 | 1.48 | 8 | 255 |
| 80 | CCTGCG | 24 | 9 | 1.45 | 17 | 256 |
| 81 | CTGCGC | 23 | 8 | 1.32 | 14 | 257 |
| 82 | GACCCC | 47 | 24 | 1.31 | 33 | 258 |
| 83 | GCTCCA | 66 | 38 | 1.25 | 39 | 259 |
| 84 | CGCCAC | 33 | 15 | 1.19 | 21 | 260 |
| 85 | GCGGGA | 23 | 9 | 1.17 | 18 | 261 |
| 86 | CTGCGA | 18 | 6 | 1.15 | 15 | 262 |
| 87 | CTGCTC | 80 | 49 | 1.14 | 50 | 263 |
| 88 | CAGACG | 23 | 9 | 1.13 | 19 | 264 |
| 89 | CGAGAG | 21 | 8 | 1.09 | 17 | 265 |
| 90 | CGGTGC | 18 | 6 | 1.06 | 16 | 266 |
| 91 | CTCCCC | 84 | 53 | 1.05 | 47 | 267 |
| 92 | GCGGCC | 22 | 8 | 1.04 | 14 | 268 |

TABLE 6-continued

Oligonucleotide patterns (6 base pairs) over-represented in STAR elements.
The patterns are ranked according to significance coefficient. These were determined
using RSA-Tools with the sequence of the human genome as reference. Patterns
that comprise the most discriminant variables in Linear Discriminant Analysis
are indicated with an asterisk. (SEQ ID NOS: 177-342)

| Number | Oligonucleotide sequence | Observed occurrences | Expected occurrences | Significance coefficient | Number of matching STARs | SEQ ID NO: |
|---|---|---|---|---|---|---|
| 93 | CGGCGC | 14 | 4 | 1.04 | 13 | 269 |
| 94 | AAGCCC * | 60 | 34 | 1.03 | 42 | 270 |
| 95 | CCGCAG | 24 | 9 | 1.03 | 17 | 271 |
| 96 | GCCCAC | 59 | 34 | 0.95 | 35 | 272 |
| 97 | CACCCA | 92 | 60 | 0.93 | 49 | 273 |
| 98 | GCGCCC | 27 | 11 | 0.93 | 18 | 274 |
| 99 | ACCGGC | 15 | 4 | 0.92 | 13 | 275 |
| 100 | CTCGCA | 16 | 5 | 0.89 | 14 | 276 |
| 101 | ACGCTC | 16 | 5 | 0.88 | 12 | 211 |
| 102 | CTGGAC | 58 | 33 | 0.88 | 32 | 278 |
| 103 | GCCCCA | 67 | 40 | 0.87 | 38 | 279 |
| 104 | ACCGTC | 15 | 4 | 0.86 | 11 | 280 |
| 105 | CCCTCG | 21 | 8 | 0.8 | 18 | 281 |
| 106 | AGCCCG | 22 | 8 | 0.79 | 14 | 282 |
| 107 | ACCCGA | 16 | 5 | 0.78 | 13 | 283 |
| 108 | AGCAGC | 79 | 50 | 0.75 | 41 | 284 |
| 109 | ACCGCG | 14 | 4 | 0.69 | 7 | 285 |
| 110 | CGAGGC | 29 | 13 | 0.69 | 24 | 286 |
| 111 | AGCTGC | 70 | 43 | 0.64 | 36 | 287 |
| 112 | GGGGAC | 49 | 27 | 0.64 | 34 | 288 |
| 113 | CCGCAA | 16 | 5 | 0.64 | 12 | 289 |
| 114 | CGTCGC | 8 | 1 | 0.62 | 6 | 290 |
| 115 | CGTGAC | 17 | 6 | 0.57 | 15 | 291 |
| 116 | CGCCCA | 33 | 16 | 0.56 | 22 | 292 |
| 117 | CTCTGC | 97 | 65 | 0.54 | 47 | 293 |
| 118 | AGCGGG | 21 | 8 | 0.52 | 17 | 294 |
| 119 | ACCGCT | 15 | 5 | 0.5 | 11 | 295 |
| 120 | CCCAGG | 133 | 95 | 0.49 | 58 | 296 |
| 121 | CCCTCA | 71 | 45 | 0.49 | 39 | 297 |
| 122 | CCCCCA * | 77 | 49 | 0.49 | 42 | 298 |
| 123 | GGCGAA | 16 | 5 | 0.48 | 14 | 299 |
| 124 | CGGCTC | 29 | 13 | 0.47 | 19 | 300 |
| 125 | CTCGCC | 20 | 8 | 0.46 | 17 | 301 |
| 126 | CGGAGA | 20 | 8 | 0.45 | 14 | 302 |
| 127 | TCCCCA | 95 | 64 | 0.43 | 52 | 303 |
| 128 | GACACC | 44 | 24 | 0.42 | 33 | 304 |
| 129 | CTCCGA | 17 | 6 | 0.42 | 13 | 305 |
| 130 | CTCGTC | 17 | 6 | 0.42 | 14 | 306 |
| 131 | CGACCA | 13 | 4 | 0.39 | 11 | 307 |
| 132 | ATGACG | 17 | 6 | 0.37 | 12 | 308 |
| 133 | CCATCG | 17 | 6 | 0.37 | 13 | 309 |
| 134 | AGGGGA | 78 | 51 | 0.36 | 44 | 310 |
| 135 | GCTGCA | 77 | 50 | 0.35 | 43 | 311 |
| 136 | ACCCCA | 76 | 49 | 0.33 | 40 | 312 |
| 137 | CGGAGC | 21 | 9 | 0.33 | 16 | 313 |
| 138 | CCTCCG | 28 | 13 | 0.32 | 19 | 314 |
| 139 | CGGGAC | 16 | 6 | 0.3 | 10 | 315 |
| 140 | CCTGGA | 88 | 59 | 0.3 | 45 | 316 |
| 141 | AGGCGA | 18 | 7 | 0.29 | 17 | 317 |
| 142 | ACCCCT | 54 | 32 | 0.28 | 36 | 318 |
| 143 | GCTCCC | 56 | 34 | 0.27 | 36 | 319 |
| 144 | CGTCAC | 16 | 6 | 0.27 | 15 | 320 |
| 145 | AGCGCA | 16 | 6 | 0.26 | 11 | 321 |
| 146 | GAAGCC | 62 | 38 | 0.25 | 39 | 322 |
| 147 | GAGGCC | 79 | 52 | 0.22 | 42 | 323 |
| 148 | ACCCTC | 54 | 32 | 0.22 | 33 | 324 |
| 149 | CCCGGC | 37 | 20 | 0.21 | 21 | 325 |
| 150 | CGAGAA | 20 | 8 | 0.2 | 17 | 326 |
| 151 | CCACCG | 29 | 14 | 0.18 | 20 | 327 |
| 152 | ACTTCG | 16 | 6 | 0.17 | 14 | 328 |
| 153 | GATGAC | 48 | 28 | 0.17 | 35 | 329 |
| 154 | ACGAGG | 23 | 10 | 0.16 | 18 | 330 |
| 155 | CCGGAG | 20 | 8 | 0.15 | 18 | 331 |
| 156 | ACCCAC | 60 | 37 | 0.12 | 41 | 332 |
| 157 | CTGGGC | 105 | 74 | 0.11 | 50 | 333 |
| 158 | CCACGG | 23 | 10 | 0.09 | 19 | 334 |
| 159 | CGGTCC | 13 | 4 | 0.09 | 12 | 335 |
| 160 | AGCACC * | 54 | 33 | 0.09 | 40 | 336 |
| 161 | ACACCC | 53 | 32 | 0.08 | 38 | 337 |

TABLE 6-continued

Oligonucleotide patterns (6 base pairs) over-represented in STAR elements.
The patterns are ranked according to significance coefficient. These were determined
using RSA-Tools with the sequence of the human genome as reference. Patterns
that comprise the most discriminant variables in Linear Discriminant Analysis
are indicated with an asterisk. (SEQ ID NOS: 177-342)

| Number | Oligonucleotide sequence | Observed occurrences | Expected occurrences | Significance coefficient | Number of matching STARs | SEQ ID NO: |
|---|---|---|---|---|---|---|
| 162 | AGGGCC | 54 | 33 | 0.08 | 30 | 338 |
| 163 | CGCGAA | 6 | 1 | 0.02 | 6 | 339 |
| 164 | GAGCCC | 58 | 36 | 0.02 | 36 | 340 |
| 165 | CTGAGC | 71 | 46 | 0.02 | 45 | 341 |
| 166 | AATCGG | 13 | 4 | 0.02 | 11 | 342 |

TABLE 7

Dyad patterns over-represented in STAR elements. The patterns are ranked
according to significance coefficient. These were determined using RSA-Tools
with the random sequence from the human genome as reference. Patterns that
comprise the most discriminant variables in Linear Discriminant Analysis
are indicated with an asterisk. (SEQ ID NOS:343-1072)

| Number | Dyad sequence | Observed occurrences | Expected occurrences | Significance coefficient | SEQ ID NO: |
|---|---|---|---|---|---|
| 1 | CCCN{2}CGG | 36 | 7 | 9.31 | 343 |
| 2 | CCGN{6}CCC | 40 | 10 | 7.3 | 344 |
| 3 | CAGN{0}CGG | 36 | 8 | 7.13 | 345 |
| 4 | CGCN{15}CCC | 34 | 8 | 6.88 | 346 |
| 5 | CGGN{9}GCC | 33 | 7 | 6.82 | 347 |
| 6 | CCCN{9}CGC | 35 | 8 | 6.72 | 348 |
| 7 | CCCN{1}GCG | 34 | 8 | 6.64 | 349 |
| 8 | CCCN{0}CAC | 103 | 48 | 6.61 | 350 |
| 9 | AGCN{16}CCG | 29 | 6 | 5.96 | 351 |
| 10 | CCCN{4}CGC | 34 | 8 | 5.8 | 352 |
| 11 | CGCN{13}GGA | 26 | 5 | 5.77 | 353 |
| 12 | GCGN{16}CCC | 30 | 7 | 5.74 | 354 |
| 13 | CGCN{5}GCA | 25 | 5 | 5.49 | 355 |
| 14 | CCCN{14}CCC | 101 | 49 | 5.43 | 356 |
| 15 | CTGN{4}CGC | 34 | 9 | 5.41 | 357 |
| 16 | CCAN{12}GCG | 28 | 6 | 5.37 | 358 |
| 17 | CGGN{11}CAG | 36 | 10 | 5.25 | 359 |
| 18 | CCCN{5}GCC | 75 | 33 | 4.87 | 360 |
| 19 | GCCN{0}CCC | 64 | 26 | 4.81 | 361 |
| 20 | CGCN{4}GAC | 19 | 3 | 4.78 | 362 |
| 21 | CGGN{0}CAG | 33 | 9 | 4.76 | 363 |
| 22 | CCCN{3}CGC | 32 | 8 | 4.67 | 364 |
| 23 | CGCN{1}GAC | 20 | 3 | 4.58 | 365 |
| 24 | GCGN{2}GCC | 29 | 7 | 4.54 | 366 |
| 25 | CCCN{4}GCC | 76 | 34 | 4.53 | 367 |
| 26 | CCCN{1}CCC | 103 | 52 | 4.53 | 368 |
| 27 | CCGN{13}CAG | 33 | 9 | 4.5 | 369 |
| 28 | GCCN{4}GGA | 64 | 27 | 4.48 | 370 |
| 29 | CCGN{3}GGA | 26 | 6 | 4.46 | 371 |
| 30 | AGGN{2}GGG | 118 | 63 | 4.44 | 372 |
| 31 | CACN{5}GCG | 22 | 4 | 4.42 | 373 |
| 32 | CGCN{17}CCA | 27 | 6 | 4.39 | 374 |
| 33 | CCCN{9}GGC | 69 | 30 | 4.38 | 375 |
| 34 | CCTN{5}GCG | 28 | 7 | 4.37 | 376 |
| 35 | GCGN{0}GAC | 19 | 3 | 4.32 | 377 |
| 36 | GCCN{0}GGC | 40 | 7 | 4.28 | 378 |
| 37 | GCGN{2}CCC | 26 | 6 | 4.27 | 379 |
| 38 | CCGN{11}CCC | 32 | 9 | 4.17 | 380 |
| 39 | CCCN{8}TCG | 23 | 5 | 4.12 | 381 |
| 40 | CCGN{17}GCC | 30 | 8 | 4.12 | 382 |
| 41 | GGGN{5}GGA | 101 | 52 | 4.11 | 383 |
| 42 | GGCN{6}GGA | 71 | 32 | 4.1 | 384 |
| 43 | CCAN{4}CCC | 96 | 48 | 4.1 | 385 |
| 44 | CCTN{14}CCG | 32 | 9 | 4.09 | 386 |
| 45 | GACN{12}GGC | 45 | 16 | 4.07 | 387 |
| 46 | CGCN{13}CCC | 30 | 8 | 4.04 | 388 |
| 47 | CAGN{16}CCC | 92 | 46 | 4.02 | 389 |
| 48 | AGCN{10}GGG | 75 | 35 | 3.94 | 390 |
| 49 | CGGN{13}GGC | 30 | 8 | 3.93 | 391 |

TABLE 7-continued

Dyad patterns over-represented in STAR elements. The patterns are ranked according to significance coefficient. These were determined using RSA-Tools with the random sequence from the human genome as reference. Patterns that comprise the most discriminant variables in Linear Discriminant Analysis are indicated with an asterisk. (SEQ ID NOS:343-1072)

| Number | Dyad sequence | Observed occurrences | Expected occurrences | Significance coefficient | SEQ ID NO: |
|---|---|---|---|---|---|
| 50 | CGGN{1}GCC | 30 | 8 | 3.92 | 392 |
| 51 | AGCN{0}GGC | 26 | 6 | 3.9 | 393 |
| 52 | CCCN{16}GGC | 64 | 28 | 3.89 | 394 |
| 53 | GCTN{19}CCC | 67 | 29 | 3.87 | 395 |
| 54 | CCCN{16}GGG | 88 | 31 | 3.81 | 396 |
| 55 | CCCN{9}CGG | 30 | 8 | 3.77 | 397 |
| 56 | CCCN{10}CGG | 30 | 8 | 3.76 | 398 |
| 57 | CCAN{0}GCG | 32 | 9 | 3.75 | 399 |
| 58 | GCCN{17}CGC | 26 | 6 | 3.74 | 400 |
| 59 | CCTN{6}CGC | 27 | 7 | 3.73 | 401 |
| 60 | GGAN{1}CCC | 63 | 27 | 3.71 | 402 |
| 61 | CGCN{18}CAC | 24 | 5 | 3.7 | 403 |
| 62 | CGCN{20}CCG | 21 | 4 | 3.69 | 404 |
| 63 | CCGN{0}GCA | 26 | 6 | 3.69 | 405 |
| 64 | CGCN{20}CCC | 28 | 7 | 3.69 | 406 |
| 65 | AGCN{15}CCC | 67 | 30 | 3.65 | 407 |
| 66 | CCTN{7}GGC | 69 | 31 | 3.63 | 408 |
| 67 | GCCN{5}CGC | 32 | 9 | 3.61 | 409 |
| 68 | GCCN{14}CGC | 28 | 7 | 3.59 | 410 |
| 69 | CAGN{11}CCC | 89 | 45 | 3.58 | 411 |
| 70 | GGGN{16}GAC | 53 | 21 | 3.57 | 412 |
| 71 | CCCN{15}GCG | 25 | 6 | 3.57 | 413 |
| 72 | CCCN{0}CGC | 37 | 12 | 3.54 | 414 |
| 73 | CCCN{16}AGC * | 67 | 30 | 3.54 | 415 |
| 74 | AGGN{9}GGG | 96 | 50 | 3.52 | 416 |
| 75 | CGCN{12}CTC | 28 | 7 | 3.46 | 417 |
| 76 | CACN{8}CGC | 23 | 5 | 3.43 | 418 |
| 77 | CCAN{7}CCG | 31 | 9 | 3.42 | 419 |
| 78 | CGGN{1}GCA | 25 | 6 | 3.41 | 420 |
| 79 | CGCN{14}CCC | 29 | 8 | 3.4 | 421 |
| 80 | AGCN{0}CCC | 76 | 36 | 3.4 | 422 |
| 81 | CGCN{13}GTC | 18 | 3 | 3.37 | 423 |
| 82 | GCGN{3}GCA | 26 | 7 | 3.35 | 424 |
| 83 | CGGN{0}GGC | 34 | 11 | 3.35 | 425 |
| 84 | GCCN{14}CCC | 68 | 31 | 3.33 | 426 |
| 85 | ACCN{7}CGC | 21 | 4 | 3.32 | 427 |
| 86 | AGGN{7}CGG | 33 | 10 | 3.31 | 428 |
| 87 | CCCN{16}CGA | 22 | 5 | 3.3 | 429 |
| 88 | CGCN{6}CAG | 31 | 9 | 3.29 | 430 |
| 89 | CAGN{11}GCG | 29 | 8 | 3.29 | 431 |
| 90 | CCGN{12}CCG | 19 | 4 | 3.26 | 432 |
| 91 | CGCN{18}CAG | 27 | 7 | 3.24 | 433 |
| 92 | CAGN{1}GGG | 80 | 39 | 3.21 | 434 |
| 93 | CGCN{0}CCC | 32 | 10 | 3.2 | 435 |
| 94 | GCGN{18}GCC | 26 | 7 | 3.18 | 436 |
| 95 | CGGN{15}GGC | 27 | 7 | 3.15 | 437 |
| 96 | CCCN{15}AGG | 72 | 34 | 3.14 | 438 |
| 97 | AGGN{20}GCG | 26 | 7 | 3.14 | 439 |
| 98 | CGGN{5}CTC | 26 | 7 | 3.13 | 440 |
| 99 | TCCN{17}CGA | 23 | 5 | 3.12 | 441 |
| 100 | GCGN{4}CCC | 30 | 9 | 3.08 | 442 |
| 101 | CCCN{2}CGC | 30 | 9 | 3.07 | 443 |
| 102 | CGTN{3}CAG | 28 | 8 | 3.06 | 444 |
| 103 | CCGN{13}GAG | 27 | 7 | 3.05 | 445 |
| 104 | CTCN{6}CGC | 28 | 8 | 3.04 | 446 |
| 105 | CGCN{4}GAG | 21 | 5 | 3.03 | 447 |
| 106 | GCGN{5}GGA | 24 | 6 | 3.03 | 448 |
| 107 | CCGN{1}CAG | 27 | 7 | 3.01 | 449 |
| 108 | CGCN{11}CCG | 18 | 3 | 2.99 | 450 |
| 109 | GCGN{19}CCC | 26 | 7 | 2.98 | 451 |
| 110 | CGCN{18}GAA | 21 | 5 | 2.98 | 452 |
| 111 | GGGN{19}GGA | 78 | 39 | 2.95 | 453 |
| 112 | CCAN{1}CGG | 24 | 6 | 2.94 | 454 |
| 113 | CCCN{7}GCG | 25 | 6 | 2.94 | 455 |
| 114 | AGGN{10}CCC | 84 | 43 | 2.92 | 456 |
| 115 | CCAN{0}GGG | 97 | 52 | 2.88 | 457 |
| 116 | CAGN{10}CCC | 82 | 41 | 2.87 | 458 |
| 117 | CCGN{18}CCG | 19 | 4 | 2.86 | 459 |
| 118 | CCGN{18}GGC | 26 | 7 | 2.85 | 460 |
| 119 | CCCN{2}GCG | 24 | 6 | 2.84 | 461 |

TABLE 7-continued

Dyad patterns over-represented in STAR elements. The patterns are ranked according to significance coefficient. These were determined using RSA-Tools with the random sequence from the human genome as reference. Patterns that comprise the most discriminant variables in Linear Discriminant Analysis are indicated with an asterisk. (SEQ ID NOS:343-1072)

| Number | Dyad sequence | Observed occurrences | Expected occurrences | Significance coefficient | SEQ ID NO: |
|---|---|---|---|---|---|
| 120 | CGCN{1}GGC | 25 | 7 | 2.83 | 462 |
| 121 | CCGN{5}GAC | 19 | 4 | 2.81 | 463 |
| 122 | GGAN{0}CCC | 52 | 22 | 2.8 | 464 |
| 123 | CCCN{1}CCG | 29 | 9 | 2.78 | 465 |
| 124 | CCCN{15}ACG | 23 | 6 | 2.75 | 466 |
| 125 | AGCN{8}CCC | 66 | 31 | 2.73 | 467 |
| 126 | CCCN{3}GGC | 60 | 27 | 2.71 | 468 |
| 127 | AGGN{9}CGG | 31 | 10 | 2.7 | 469 |
| 128 | CCCN{14}CGC | 27 | 8 | 2.7 | 470 |
| 129 | CCGN{0}CCG | 19 | 4 | 2.7 | 471 |
| 130 | CGCN{8}AGC | 23 | 6 | 2.69 | 472 |
| 131 | CGCN{19}ACC | 21 | 5 | 2.68 | 473 |
| 132 | GCGN{17}GAC | 17 | 3 | 2.66 | 474 |
| 133 | AGCN{1}GCG | 24 | 6 | 2.63 | 475 |
| 134 | CCGN{11}GGC | 31 | 10 | 2.63 | 476 |
| 135 | CGGN{4}AGA | 26 | 7 | 2.63 | 477 |
| 136 | CGCN{14}CCG | 17 | 3 | 2.62 | 478 |
| 137 | CCTN{20}GCG | 24 | 6 | 2.62 | 479 |
| 138 | CCAN{10}CGC | 26 | 7 | 2.61 | 480 |
| 139 | CCCN{20}CAC | 69 | 33 | 2.6 | 481 |
| 140 | CCGN{11}GCC | 27 | 8 | 2.6 | 482 |
| 141 | CGCN{18}CCC | 26 | 7 | 2.59 | 483 |
| 142 | CGGN{15}CGC | 16 | 3 | 2.57 | 484 |
| 143 | CGCN{16}GCC | 24 | 6 | 2.55 | 485 |
| 144 | CGCN{20}GGC | 23 | 6 | 2.54 | 486 |
| 145 | CGCN{19}CCG | 18 | 4 | 2.52 | 487 |
| 146 | CGGN{10}CCA | 28 | 8 | 2.51 | 488 |
| 147 | CGCN{17}CCC | 26 | 7 | 2.51 | 489 |
| 148 | CGCN{11}ACA | 23 | 6 | 2.51 | 490 |
| 149 | CGGN{0}ACC | 17 | 3 | 2.5 | 491 |
| 150 | GCGN{10}GCC | 24 | 6 | 2.49 | 492 |
| 151 | GCGN{8}GAC | 17 | 3 | 2.49 | 493 |
| 152 | CCCN{15}GGG | 84 | 32 | 2.44 | 494 |
| 153 | CGGN{16}GGC | 27 | 8 | 2.44 | 495 |
| 154 | CGCN{16}CCA | 23 | 6 | 2.42 | 496 |
| 155 | GCCN{3}CCC | 73 | 36 | 2.4 | 497 |
| 156 | CAGN{4}GGG | 94 | 51 | 2.4 | 498 |
| 157 | CCCN{6}GCG | 23 | 6 | 2.38 | 499 |
| 158 | CCGN{16}CGC | 17 | 3 | 2.38 | 500 |
| 159 | CCCN{17}GCA | 61 | 28 | 2.37 | 501 |
| 160 | CGCN{13}TCC | 24 | 6 | 2.37 | 502 |
| 161 | GCCN{1}CGC | 29 | 9 | 2.36 | 503 |
| 162 | CCGN{19}GAG | 26 | 7 | 2.35 | 504 |
| 163 | GGGN{10}GGA | 89 | 48 | 2.35 | 505 |
| 164 | CAGN{5}CCG | 32 | 11 | 2.35 | 506 |
| 165 | CGCN{3}AGA | 19 | 4 | 2.32 | 507 |
| 166 | GCCN{0}GCC | 29 | 9 | 2.32 | 508 |
| 167 | CCCN{8}GGC | 61 | 28 | 2.31 | 509 |
| 168 | CCTN{6}GCG | 22 | 6 | 2.29 | 510 |
| 169 | GACN{6}CCC | 48 | 20 | 2.29 | 511 |
| 170 | CGGN{1}CCC | 26 | 8 | 2.27 | 512 |
| 171 | CCCN{15}CCG | 30 | 10 | 2.27 | 513 |
| 172 | CAGN{9}CCC | 84 | 44 | 2.26 | 514 |
| 173 | CGGN{10}GGC | 27 | 8 | 2.26 | 515 |
| 174 | CGAN{10}ACG | 10 | 1 | 2.26 | 516 |
| 175 | GCGN{3}TCC | 21 | 5 | 2.26 | 517 |
| 176 | CCCN{3}GCC | 75 | 38 | 2.24 | 518 |
| 177 | GCGN{1}ACC | 17 | 3 | 2.24 | 519 |
| 178 | CCGN{9}AGG | 27 | 8 | 2.23 | 520 |
| 179 | CGCN{16}CAG | 26 | 8 | 2.23 | 521 |
| 180 | GGCN{0}CCC | 62 | 29 | 2.22 | 522 |
| 181 | AGGN{12}CCG | 26 | 8 | 2.19 | 523 |
| 182 | CCGN{0}GCG | 16 | 3 | 2.19 | 524 |
| 183 | CCGN{2}GCC | 30 | 10 | 2.18 | 525 |
| 184 | CCGN{11}GTC | 19 | 4 | 2.17 | 526 |
| 185 | CAGN{0}CCC | 88 | 47 | 2.17 | 527 |
| 186 | CCCN{5}CCG | 32 | 11 | 2.17 | 528 |
| 187 | GCCN{20}CCC | 66 | 32 | 2.15 | 529 |
| 188 | GACN{2}CGC | 18 | 4 | 2.14 | 530 |
| 189 | CGCN{6}CAC | 23 | 6 | 2.13 | 531 |

TABLE 7-continued

Dyad patterns over-represented in STAR elements. The patterns are ranked according to significance coefficient. These were determined using RSA-Tools with the random sequence from the human genome as reference. Patterns that comprise the most discriminant variables in Linear Discriminant Analysis are indicated with an asterisk. (SEQ ID NOS:343-1072)

| Number | Dyad sequence | Observed occurrences | Expected occurrences | Significance coefficient | SEQ ID NO: |
|---|---|---|---|---|---|
| 190 | AGGN{14}GCG | 25 | 7 | 2.1 | 532 |
| 191 | GACN{5}CGC | 17 | 3 | 2.1 | 533 |
| 192 | CCTN{19}CCG | 29 | 9 | 2.1 | 534 |
| 193 | CCGN{12}GGA | 24 | 7 | 2.08 | 535 |
| 194 | GGCN{9}GAC * | 44 | 18 | 2.08 | 536 |
| 195 | AGGN{10}GGG | 94 | 52 | 2.07 | 537 |
| 196 | CCGN{10}GAG | 25 | 7 | 2.07 | 538 |
| 197 | CGCN{6}GGA | 20 | 5 | 2.06 | 539 |
| 198 | CGCN{7}AGC | 23 | 6 | 2.04 | 540 |
| 199 | CCAN{13}CGG | 26 | 8 | 2.03 | 541 |
| 200 | CGGN{6}GGA | 25 | 7 | 2.03 | 542 |
| 201 | CGCN{19}GCC | 24 | 7 | 2.03 | 543 |
| 202 | CCAN{12}CGC | 24 | 7 | 2.02 | 544 |
| 203 | CGGN{1}GGC | 41 | 16 | 2.02 | 545 |
| 204 | GCGN{3}CCA | 25 | 7 | 2.01 | 546 |
| 205 | AGGN{1}CGC | 21 | 5 | 2 | 547 |
| 206 | CTCN{5}CGC | 24 | 7 | 1.98 | 548 |
| 207 | CCCN{0}ACG | 30 | 10 | 1.97 | 549 |
| 208 | CAGN{17}CCG | 29 | 9 | 1.96 | 550 |
| 209 | GGCN{4}CCC | 62 | 30 | 1.96 | 551 |
| 210 | AGGN{8}GCG | 26 | 8 | 1.96 | 552 |
| 211 | CTGN{1}CCC | 88 | 48 | 1.94 | 553 |
| 212 | CCCN{16}CAG | 85 | 46 | 1.94 | 554 |
| 213 | CGCN{9}GAC | 16 | 3 | 1.93 | 555 |
| 214 | CAGN{6}CCG | 29 | 9 | 1.92 | 556 |
| 215 | CGTN{12}CGC | 11 | 1 | 1.92 | 557 |
| 216 | CTCN{7}GCC | 69 | 35 | 1.92 | 558 |
| 217 | CGCN{19}TCC | 22 | 6 | 1.92 | 559 |
| 218 | CCCN{7}GCC | 67 | 33 | 1.91 | 560 |
| 219 | CAGN{13}CGG | 30 | 10 | 1.9 | 561 |
| 220 | CGCN{1}GCC | 27 | 8 | 1.9 | 562 |
| 221 | CGCN{17}CCG | 17 | 4 | 1.89 | 563 |
| 222 | AGGN{4}CCC | 63 | 31 | 1.89 | 564 |
| 223 | AGCN{10}CGC | 21 | 5 | 1.89 | 565 |
| 224 | CCCN{11}CGG | 30 | 10 | 1.88 | 566 |
| 225 | CCCN{8}GCC | 75 | 39 | 1.86 | 567 |
| 226 | CCGN{1}CGG | 22 | 3 | 1.86 | 568 |
| 227 | CCCN{1}ACC | 71 | 36 | 1.85 | 569 |
| 228 | CGCN{0}CAG | 25 | 7 | 1.85 | 570 |
| 229 | CCGN{19}TGC | 23 | 6 | 1.82 | 571 |
| 230 | GCGN{4}CGA | 12 | 2 | 1.82 | 572 |
| 231 | CCGN{19}GCC | 30 | 10 | 1.82 | 573 |
| 232 | CCAN{10}CCC | 85 | 46 | 1.81 | 574 |
| 233 | CAGN{13}GGG | 91 | 51 | 1.81 | 575 |
| 234 | AGCN{18}CGG | 23 | 6 | 1.81 | 576 |
| 235 | CGAN{8}CGC | 11 | 1 | 1.81 | 577 |
| 236 | AGCN{4}CCC | 63 | 31 | 1.8 | 578 |
| 237 | GGAN{6}CCC | 61 | 30 | 1.8 | 579 |
| 238 | CGGN{13}AAG | 23 | 6 | 1.8 | 580 |
| 239 | ACCN{11}CGC | 19 | 5 | 1.79 | 581 |
| 240 | CCGN{12}CAG | 28 | 9 | 1.78 | 582 |
| 241 | CCCN{12}GGG | 76 | 29 | 1.77 | 583 |
| 242 | CACN{17}ACG | 22 | 6 | 1.76 | 584 |
| 243 | CAGN{18}CCC | 82 | 44 | 1.76 | 585 |
| 244 | CGTN{10}GTC | 19 | 5 | 1.75 | 586 |
| 245 | CCCN{13}GCG | 23 | 6 | 1.75 | 587 |
| 246 | GCAN{1}CGC | 20 | 5 | 1.73 | 588 |
| 247 | AGAN{4}CCG | 24 | 7 | 1.73 | 589 |
| 248 | GCGN{10}AGC | 22 | 6 | 1.72 | 590 |
| 249 | CGCN{0}GGA | 12 | 2 | 1.72 | 591 |
| 250 | CGGN{4}GAC | 17 | 4 | 1.69 | 592 |
| 251 | CCCN{12}CGC | 26 | 8 | 1.68 | 593 |
| 252 | GCCN{15}CCC | 65 | 33 | 1.68 | 594 |
| 253 | GCGN{6}TCC | 20 | 5 | 1.66 | 595 |
| 254 | CGGN{3}CAG | 33 | 12 | 1.65 | 596 |
| 255 | CCCN{3}CCA | 88 | 49 | 1.65 | 597 |
| 256 | AGCN{3}CCC | 59 | 28 | 1.65 | 598 |
| 257 | GGGN{16}GCA | 65 | 33 | 1.65 | 599 |
| 258 | AGGN{8}CCG | 28 | 9 | 1.64 | 600 |
| 259 | CCCN{0}CCG | 29 | 10 | 1.64 | 601 |

TABLE 7-continued

Dyad patterns over-represented in STAR elements. The patterns are ranked according to significance coefficient. These were determined using RSA-Tools with the random sequence from the human genome as reference. Patterns that comprise the most discriminant variables in Linear Discriminant Analysis are indicated with an asterisk. (SEQ ID NOS:343-1072)

| Number | Dyad sequence | Observed occurrences | Expected occurrences | Significance coefficient | SEQ ID NO: |
|---|---|---|---|---|---|
| 260 | GCGN{5}GAC | 16 | 3 | 1.64 | 602 |
| 261 | CCCN{9}ACC | 60 | 29 | 1.64 | 603 |
| 262 | CTGN{5}CGC | 25 | 8 | 1.64 | 604 |
| 263 | CGCN{14}CTC | 23 | 7 | 1.64 | 605 |
| 264 | CGGN{14}GCA | 23 | 7 | 1.63 | 606 |
| 265 | CCGN{8}GCC | 26 | 8 | 1.62 | 607 |
| 266 | CCGN{7}CAC | 23 | 7 | 1.62 | 608 |
| 267 | AGCN{8}GCG | 21 | 6 | 1.61 | 609 |
| 268 | CGGN{16}GGA | 29 | 10 | 1.61 | 610 |
| 269 | CCAN{12}CCG | 26 | 8 | 1.61 | 611 |
| 270 | CGGN{2}CCC | 26 | 8 | 1.6 | 612 |
| 271 | CCAN{13}GGG | 71 | 37 | 1.6 | 613 |
| 272 | CGGN{15}GCA | 21 | 6 | 1.6 | 614 |
| 273 | CGCN{9}GCA | 20 | 5 | 1.58 | 615 |
| 274 | CGGN{19}CCA | 26 | 8 | 1.58 | 616 |
| 275 | GGGN{15}CGA | 20 | 5 | 1.57 | 617 |
| 276 | CCCN{10}CGC | 26 | 8 | 1.57 | 618 |
| 277 | CTCN{14}CGC | 26 | 8 | 1.55 | 619 |
| 278 | CACN{11}GCG | 20 | 5 | 1.55 | 620 |
| 279 | CCGN{2}GGC | 24 | 7 | 1.55 | 621 |
| 280 | CTGN{18}CCC | 85 | 47 | 1.54 | 622 |
| 281 | GGGN{13}CAC | 58 | 28 | 1.54 | 623 |
| 282 | CCTN{15}GGC | 62 | 31 | 1.54 | 624 |
| 283 | CCCN{20}CGA | 20 | 5 | 1.54 | 625 |
| 284 | CCCN{8}CGA | 20 | 5 | 1.53 | 626 |
| 285 | GAGN{7}CCC | 61 | 30 | 1.53 | 627 |
| 286 | CGCN{2}CCG | 22 | 6 | 1.53 | 628 |
| 287 | CCCN{0}TCC | 98 | 57 | 1.52 | 629 |
| 288 | AGCN{0}GCC | 21 | 6 | 1.52 | 630 |
| 289 | CCCN{2}TCC | 82 | 45 | 1.52 | 631 |
| 290 | CCGN{5}CCC | 30 | 10 | 1.52 | 632 |
| 291 | CGCN{13}CGC | 16 | 3 | 1.51 | 633 |
| 292 | CCCN{1}CGC | 28 | 9 | 1.51 | 634 |
| 293 | GCCN{16}GCA | 53 | 25 | 1.51 | 635 |
| 294 | CCCN{16}CCA | 84 | 46 | 1.5 | 636 |
| 295 | CCGN{13}CGC | 19 | 5 | 1.5 | 637 |
| 296 | CCGN{17}CAG | 28 | 9 | 1.49 | 638 |
| 297 | CGGN{18}GGC | 26 | 8 | 1.49 | 639 |
| 298 | CCGN{14}AGG | 23 | 7 | 1.49 | 640 |
| 299 | CCCN{5}CGG | 26 | 8 | 1.49 | 641 |
| 300 | CCCN{6}GGA | 58 | 28 | 1.49 | 642 |
| 301 | ACGN{2}CCC | 20 | 5 | 1.49 | 643 |
| 302 | CCAN{9}CCG | 27 | 9 | 1.48 | 644 |
| 303 | CCCN{19}CCA | 78 | 42 | 1.48 | 645 |
| 304 | CAGN{0}GGG | 77 | 41 | 1.48 | 646 |
| 305 | AGCN{1}CCC | 58 | 28 | 1.47 | 647 |
| 306 | GCGN{7}TCC | 27 | 9 | 1.46 | 648 |
| 307 | ACGN{18}CCA | 25 | 8 | 1.46 | 649 |
| 308 | GCTN{14}CCC | 61 | 30 | 1.46 | 650 |
| 309 | GCGN{14}CCC | 23 | 7 | 1.46 | 651 |
| 310 | GCGN{19}AGC | 20 | 5 | 1.45 | 652 |
| 311 | CCGN{8}CAG | 29 | 10 | 1.45 | 653 |
| 312 | GCGN{6}GCC | 22 | 6 | 1.45 | 654 |
| 313 | GCGN{10}GCA | 20 | 5 | 1.44 | 655 |
| 314 | CCTN{7}GCC | 69 | 36 | 1.44 | 656 |
| 315 | GCCN{13}GCC | 54 | 26 | 1.42 | 657 |
| 316 | CCCN{14}GCC | 63 | 32 | 1.42 | 658 |
| 317 | CCCN{15}CGG | 26 | 8 | 1.42 | 659 |
| 318 | CCAN{13}CGC | 23 | 7 | 1.42 | 660 |
| 319 | AGCN{11}GGG | 67 | 35 | 1.41 | 661 |
| 320 | GGAN{0}GCC | 64 | 32 | 1.4 | 662 |
| 321 | GCCN{3}TCC | 61 | 30 | 1.4 | 663 |
| 322 | CCTN{5}GCC | 69 | 36 | 1.39 | 664 |
| 323 | CGGN{18}CCC | 25 | 8 | 1.39 | 665 |
| 324 | CCTN{3}GGC | 59 | 29 | 1.38 | 666 |
| 325 | CCGN{0}CTC | 22 | 6 | 1.38 | 667 |
| 326 | AGCN{17}GCG | 19 | 5 | 1.37 | 668 |
| 327 | ACGN{14}GGG | 20 | 5 | 1.37 | 669 |
| 328 | CGAN{12}GGC | 19 | 5 | 1.37 | 670 |
| 329 | CCCN{20}CGC | 24 | 7 | 1.37 | 671 |

TABLE 7-continued

Dyad patterns over-represented in STAR elements. The patterns are ranked according to significance coefficient. These were determined using RSA-Tools with the random sequence from the human genome as reference. Patterns that comprise the most discriminant variables in Linear Discriminant Analysis are indicated with an asterisk. (SEQ ID NOS:343-1072)

| Number | Dyad sequence | Observed occurrences | Expected occurrences | Significance coefficient | SEQ ID NO: |
|---|---|---|---|---|---|
| 330 | ACGN{12}CTG | 24 | 7 | 1.36 | 672 |
| 331 | CCGN{0}CCC | 36 | 14 | 1.36 | 673 |
| 332 | CCGN{10}GGA | 23 | 7 | 1.36 | 674 |
| 333 | CCCN{3}GCG | 21 | 6 | 1.36 | 675 |
| 334 | GCGN{14}CGC | 22 | 3 | 1.35 | 676 |
| 335 | CCGN{8}CGC | 16 | 4 | 1.35 | 677 |
| 336 | CGCN{10}ACA | 22 | 6 | 1.34 | 678 |
| 337 | CCCN{19}CCG | 28 | 10 | 1.33 | 679 |
| 338 | CACN{14}CGC | 20 | 5 | 1.32 | 680 |
| 339 | GACN{3}GGC | 46 | 21 | 1.32 | 681 |
| 340 | GAAN{7}CGC | 19 | 5 | 1.32 | 682 |
| 341 | CGCN{16}GGC | 21 | 6 | 1.31 | 683 |
| 342 | GGCN{9}CCC | 64 | 33 | 1.31 | 684 |
| 343 | CCCN{9}GCC | 64 | 33 | 1.31 | 685 |
| 344 | CGCN{0}TGC | 26 | 9 | 1.3 | 686 |
| 345 | CCTN{8}GGC | 67 | 35 | 1.3 | 687 |
| 346 | CCAN{8}CCC | 82 | 46 | 1.29 | 688 |
| 347 | GACN{2}CCC | 42 | 18 | 1.28 | 689 |
| 348 | GGCN{1}CCC | 54 | 26 | 1.27 | 690 |
| 349 | CGCN{0}AGC | 24 | 7 | 1.26 | 691 |
| 350 | AGGN{4}GCG | 28 | 10 | 1.26 | 692 |
| 351 | CGGN{6}TCC | 22 | 6 | 1.25 | 693 |
| 352 | ACGN{19}GGC | 20 | 5 | 1.25 | 694 |
| 353 | CCCN{8}ACG | 21 | 6 | 1.24 | 695 |
| 354 | CCCN{18}GCC | 62 | 31 | 1.24 | 696 |
| 355 | GCCN{2}CGA | 19 | 5 | 1.24 | 697 |
| 356 | CCCN{8}GCG | 28 | 10 | 1.23 | 698 |
| 357 | CCCN{0}CTC | 76 | 41 | 1.23 | 699 |
| 358 | GCCN{11}CGC | 27 | 9 | 1.22 | 700 |
| 359 | AGCN{9}CCC | 59 | 29 | 1.22 | 701 |
| 360 | GCTN{0}GCC | 71 | 38 | 1.21 | 702 |
| 361 | CGCN{3}CCC | 26 | 9 | 1.21 | 703 |
| 362 | CCCN{2}CCC | 117 | 72 | 1.19 | 704 |
| 363 | GCCN{9}CGC | 23 | 7 | 1.19 | 705 |
| 364 | GCAN{19}CGC | 19 | 5 | 1.19 | 706 |
| 365 | CAGN{4}CGG | 32 | 12 | 1.18 | 707 |
| 366 | CAGN{2}GGG | 80 | 44 | 1.17 | 708 |
| 367 | GCCN{16}CCC | 67 | 35 | 1.16 | 709 |
| 368 | GAGN{5}CCC | 60 | 30 | 1.16 | 710 |
| 369 | CCTN{16}TCG | 20 | 6 | 1.16 | 711 |
| 370 | CCCN{2}GGC | 62 | 32 | 1.15 | 712 |
| 371 | GCGN{13}GGA | 24 | 8 | 1.15 | 713 |
| 372 | GCCN{17}GGC | 66 | 25 | 1.15 | 714 |
| 373 | CCCN{14}GGC | 58 | 29 | 1.14 | 715 |
| 374 | AGGN{3}CCG | 31 | 12 | 1.14 | 716 |
| 375 | CACN{0}CGC | 32 | 12 | 1.14 | 717 |
| 376 | CGGN{18}CAG | 28 | 10 | 1.14 | 718 |
| 377 | AGCN{1}GCC | 57 | 28 | 1.13 | 719 |
| 378 | CGCN{18}GGC | 23 | 7 | 1.13 | 720 |
| 379 | CCCN{5}AGG | 64 | 33 | 1.11 | 721 |
| 380 | AACN{0}GCG | 9 | 1 | 1.11 | 722 |
| 381 | CCCN{10}CCA | 88 | 50 | 1.09 | 723 |
| 382 | CGCN{13}GAG | 20 | 6 | 1.09 | 724 |
| 383 | CGCN{7}GCC | 25 | 8 | 1.08 | 725 |
| 384 | CCCN{9}CCG | 28 | 10 | 1.07 | 726 |
| 385 | CGCN{16}CCC | 24 | 8 | 1.05 | 727 |
| 386 | GAAN{13}CGC | 18 | 5 | 1.05 | 728 |
| 387 | GGCN{3}CCC | 49 | 23 | 1.03 | 729 |
| 388 | TCCN{11}CCA | 87 | 50 | 1.03 | 730 |
| 389 | CACN{0}CCC | 70 | 38 | 1.02 | 731 |
| 390 | CGCN{16}CCG | 15 | 3 | 1.02 | 732 |
| 391 | CGGN{15}AGC | 21 | 6 | 1.02 | 733 |
| 392 | CCCN{12}GCG | 21 | 6 | 1.02 | 734 |
| 393 | CCCN{9}GAG | 59 | 30 | 1.01 | 735 |
| 394 | CCGN{20}TCC | 24 | 8 | 1.01 | 736 |
| 395 | CGCN{0}CGC | 17 | 4 | 1.01 | 737 |
| 396 | ATGN{7}CGG | 20 | 6 | 1 | 738 |
| 397 | GGGN{20}GCA | 59 | 30 | 1 | 739 |
| 398 | CGGN{4}GGC | 26 | 9 | 0.99 | 740 |
| 399 | CGGN{16}AGC | 22 | 7 | 0.99 | 741 |

TABLE 7-continued

Dyad patterns over-represented in STAR elements. The patterns are ranked according to significance coefficient. These were determined using RSA-Tools with the random sequence from the human genome as reference. Patterns that comprise the most discriminant variables in Linear Discriminant Analysis are indicated with an asterisk. (SEQ ID NOS:343-1072)

| Number | Dyad sequence | Observed occurrences | Expected occurrences | Significance coefficient | SEQ ID NO: |
|---|---|---|---|---|---|
| 400 | CGGN{5}GGC | 25 | 8 | 0.99 | 742 |
| 401 | GCGN{0}GGA | 25 | 8 | 0.98 | 743 |
| 402 | GGCN{20}CAC | 52 | 25 | 0.98 | 744 |
| 403 | CCCN{9}CCC | 97 | 58 | 0.97 | 745 |
| 404 | ACCN{17}GGC | 44 | 20 | 0.97 | 746 |
| 405 | CCCN{6}CGA | 18 | 5 | 0.96 | 747 |
| 406 | AAGN{10}CGG | 26 | 9 | 0.96 | 748 |
| 407 | CGCN{17}CAC | 21 | 6 | 0.95 | 749 |
| 408 | CCCN{16}CGG | 25 | 8 | 0.94 | 750 |
| 409 | GACN{18}GGC | 39 | 17 | 0.94 | 751 |
| 410 | GGGN{15}GAC | 47 | 22 | 0.92 | 752 |
| 411 | GCCN{4}TCC | 66 | 35 | 0.92 | 753 |
| 412 | GGCN{15}CCC | 56 | 28 | 0.92 | 754 |
| 413 | CAGN{12}CGC | 24 | 8 | 0.92 | 755 |
| 414 | CCAN{3}GCG | 22 | 7 | 0.91 | 756 |
| 415 | CCGN{16}GAG | 22 | 7 | 0.9 | 757 |
| 416 | AGCN{2}CGC | 24 | 8 | 0.89 | 758 |
| 417 | GAGN{4}CCC | 54 | 27 | 0.89 | 759 |
| 418 | AGGN{3}CGC | 23 | 7 | 0.88 | 760 |
| 419 | CACN{13}AGG * | 67 | 36 | 0.88 | 761 |
| 420 | CCCN{4}CAG | 88 | 51 | 0.88 | 762 |
| 421 | CCCN{2}GAA | 63 | 33 | 0.87 | 763 |
| 422 | CGCN{19}GAG | 21 | 6 | 0.87 | 764 |
| 423 | ACGN{18}GGG | 21 | 6 | 0.87 | 765 |
| 424 | CCCN{4}GGC | 62 | 32 | 0.87 | 766 |
| 425 | CGGN{9}GAG | 28 | 10 | 0.86 | 767 |
| 426 | CCCN{3}GGG | 66 | 26 | 0.86 | 768 |
| 427 | GAGN{4}GGC | 66 | 35 | 0.85 | 769 |
| 428 | CGCN{5}GAG | 18 | 5 | 0.84 | 770 |
| 429 | CCGN{20}AGG | 24 | 8 | 0.84 | 771 |
| 430 | CCCN{15}CCC | 88 | 51 | 0.83 | 772 |
| 431 | AGGN{17}CCG | 25 | 8 | 0.82 | 773 |
| 432 | AGGN{6}GGG | 89 | 52 | 0.82 | 774 |
| 433 | GGCN{20}CCC | 57 | 29 | 0.82 | 775 |
| 434 | GCAN{17}CGC | 19 | 5 | 0.82 | 776 |
| 435 | CGAN{11}ACG | 9 | 1 | 0.81 | 111 |
| 436 | CGCN{2}GGA | 19 | 5 | 0.81 | 778 |
| 437 | CTGN{5}CCC | 79 | 45 | 0.8 | 779 |
| 438 | TCCN{20}CCA | 77 | 43 | 0.8 | 780 |
| 439 | CCAN{2}GGG | 59 | 30 | 0.8 | 781 |
| 440 | CCGN{15}GCG | 14 | 3 | 0.8 | 782 |
| 441 | CCAN{5}GGG | 69 | 38 | 0.79 | 783 |
| 442 | CGGN{1}TGC | 24 | 8 | 0.79 | 784 |
| 443 | CCCN{14}GCG | 21 | 6 | 0.79 | 785 |
| 444 | CAGN{0}CCG | 27 | 10 | 0.79 | 786 |
| 445 | GCCN{9}TCC | 60 | 31 | 0.78 | 787 |
| 446 | AGGN{20}CGC | 22 | 7 | 0.78 | 788 |
| 447 | CCCN{6}GAC | 42 | 19 | 0.77 | 789 |
| 448 | CGGN{11}CCA | 23 | 7 | 0.76 | 790 |
| 449 | GGGN{14}CAC | 57 | 29 | 0.75 | 791 |
| 450 | GCAN{15}CGC | 19 | 5 | 0.74 | 792 |
| 451 | CGCN{2}ACA | 20 | 6 | 0.74 | 793 |
| 452 | ACCN{9}CCC | 57 | 29 | 0.73 | 794 |
| 453 | GCGN{9}CGC | 20 | 3 | 0.73 | 795 |
| 454 | CAGN{15}GCG | 23 | 7 | 0.73 | 796 |
| 455 | CCCN{18}GTC | 45 | 21 | 0.72 | 797 |
| 456 | GCGN{3}CCC | 24 | 8 | 0.72 | 798 |
| 457 | CGGN{11}GCC | 23 | 8 | 0.72 | 799 |
| 458 | CCCN{1}CGG | 24 | 8 | 0.71 | 800 |
| 459 | GCCN{4}CCA | 70 | 38 | 0.71 | 801 |
| 460 | CCCN{4}CCG | 30 | 12 | 0.7 | 802 |
| 461 | CGTN{2}GCA | 21 | 6 | 0.7 | 803 |
| 462 | AGCN{7}TCG | 18 | 5 | 0.69 | 804 |
| 463 | CCGN{15}GAA | 20 | 6 | 0.69 | 805 |
| 464 | ACCN{5}CCC | 62 | 33 | 0.69 | 806 |
| 465 | CGCN{14}GAG | 19 | 5 | 0.68 | 807 |
| 466 | CCCN{7}CGC | 30 | 12 | 0.68 | 808 |
| 467 | GAGN{12}CGC | 21 | 6 | 0.68 | 809 |
| 468 | GGCN{17}CCC | 58 | 30 | 0.67 | 810 |
| 469 | ACGN{11}CTC | 21 | 7 | 0.65 | 811 |

TABLE 7-continued

Dyad patterns over-represented in STAR elements. The patterns are ranked according to significance coefficient. These were determined using RSA-Tools with the random sequence from the human genome as reference. Patterns that comprise the most discriminant variables in Linear Discriminant Analysis are indicated with an asterisk. (SEQ ID NOS:343-1072)

| Number | Dyad sequence | Observed occurrences | Expected occurrences | Significance coefficient | SEQ ID NO: |
|---|---|---|---|---|---|
| 470 | ACAN{9}CGG | 24 | 8 | 0.65 | 812 |
| 471 | CTGN{7}CCC | 82 | 47 | 0.65 | 813 |
| 472 | CCCN{2}GCC | 72 | 40 | 0.65 | 814 |
| 473 | CGGN{2}GCA | 24 | 8 | 0.64 | 815 |
| 474 | CCCN{0}TGC | 83 | 48 | 0.64 | 816 |
| 475 | CGCN{7}ACC | 18 | 5 | 0.63 | 817 |
| 476 | GCAN{2}GCC | 54 | 27 | 0.63 | 818 |
| 477 | GCGN{8}CCA | 20 | 6 | 0.63 | 819 |
| 478 | AGCN{0}CGC | 22 | 7 | 0.63 | 820 |
| 479 | GCGN{2}GCA | 18 | 5 | 0.63 | 821 |
| 480 | CCGN{2}GTC | 18 | 5 | 0.62 | 822 |
| 481 | CCGN{3}ACA | 21 | 7 | 0.62 | 823 |
| 482 | ACGN{13}TGG | 21 | 7 | 0.62 | 824 |
| 483 | CCAN{8}CGC | 23 | 8 | 0.62 | 825 |
| 484 | CCGN{9}GGC | 23 | 8 | 0.61 | 826 |
| 485 | CCAN{5}CCG | 25 | 9 | 0.61 | 827 |
| 486 | AGGN{3}GGG | 97 | 59 | 0.61 | 828 |
| 487 | CAGN{2}GGC | 78 | 45 | 0.61 | 829 |
| 488 | CCCN{8}CAG | 81 | 47 | 0.61 | 830 |
| 489 | AGCN{5}CAG | 80 | 46 | 0.6 | 831 |
| 490 | CGGN{16}GCC | 22 | 7 | 0.6 | 832 |
| 491 | GCGN{15}CCC | 23 | 8 | 0.6 | 833 |
| 492 | CCCN{11}GCC | 59 | 31 | 0.59 | 834 |
| 493 | CGAN{2}ACG | 9 | 1 | 0.59 | 835 |
| 494 | CGGN{4}GCC | 22 | 7 | 0.59 | 836 |
| 495 | CACN{6}CGC | 19 | 6 | 0.59 | 837 |
| 496 | CGGN{5}ACG | 11 | 2 | 0.59 | 838 |
| 497 | CTGN{4}GCC * | 66 | 36 | 0.59 | 839 |
| 498 | GGGN{18}CGA | 18 | 5 | 0.59 | 840 |
| 499 | CCTN{8}CGC | 22 | 7 | 0.59 | 841 |
| 500 | GCCN{4}CCC | 67 | 37 | 0.58 | 842 |
| 501 | CGGN{10}GCC | 22 | 7 | 0.58 | 843 |
| 502 | GCCN{5}GGA | 54 | 27 | 0.57 | 844 |
| 503 | ACCN{7}GCG | 15 | 4 | 0.57 | 845 |
| 504 | CCCN{8}CGC | 24 | 8 | 0.57 | 846 |
| 505 | CAGN{5}CCC | 77 | 44 | 0.56 | 847 |
| 506 | CACN{14}GGA | 63 | 34 | 0.56 | 848 |
| 507 | CCCN{1}GCC | 94 | 57 | 0.55 | 849 |
| 508 | CCCN{5}AGC | 67 | 37 | 0.55 | 850 |
| 509 | GGCN{5}GGA | 59 | 31 | 0.55 | 851 |
| 510 | CGAN{17}GAG | 19 | 6 | 0.55 | 852 |
| 511 | CGCN{7}ACA | 18 | 5 | 0.54 | 853 |
| 512 | CCAN{13}CCC | 87 | 52 | 0.54 | 854 |
| 513 | CGGN{20}GGC | 24 | 8 | 0.54 | 855 |
| 514 | CCCN{17}GCC | 58 | 30 | 0.53 | 856 |
| 515 | CCTN{10}CCG | 30 | 12 | 0.53 | 857 |
| 516 | CCCN{8}CCG | 27 | 10 | 0.53 | 858 |
| 517 | CGCN{3}GAG | 18 | 5 | 0.52 | 859 |
| 518 | CGCN{7}AAG | 17 | 5 | 0.51 | 860 |
| 519 | CGGN{11}GGA | 23 | 8 | 0.51 | 861 |
| 520 | CCGN{15}CCG | 15 | 4 | 0.51 | 862 |
| 521 | CCCN{3}GCA | 57 | 30 | 0.51 | 863 |
| 522 | CGGN{2}CAG | 24 | 8 | 0.5 | 864 |
| 523 | AGGN{2}CCG | 24 | 8 | 0.5 | 865 |
| 524 | CCCN{4}CAC | 69 | 38 | 0.5 | 866 |
| 525 | GGAN{19}CCC | 56 | 29 | 0.49 | 867 |
| 526 | CCCN{8}CAC | 68 | 38 | 0.49 | 868 |
| 527 | ACCN{6}CCG | 18 | 5 | 0.49 | 869 |
| 528 | CCCN{6}GGC | 54 | 28 | 0.49 | 870 |
| 529 | CCCN{6}CCG | 29 | 11 | 0.48 | 871 |
| 530 | CGCN{14}GCC | 26 | 9 | 0.47 | 872 |
| 531 | CCGN{5}TCC | 25 | 9 | 0.46 | 873 |
| 532 | GCCN{6}GCC | 55 | 28 | 0.46 | 874 |
| 533 | CGGN{7}GGA | 24 | 8 | 0.45 | 875 |
| 534 | GGGN{6}GGA | 87 | 52 | 0.44 | 876 |
| 535 | GCCN{12}TCC | 60 | 32 | 0.44 | 877 |
| 536 | AGTN{16}CCG | 17 | 5 | 0.44 | 878 |
| 537 | GGCN{19}GCC | 68 | 29 | 0.44 | 879 |
| 538 | CCGN{3}CCG | 22 | 7 | 0.44 | 880 |
| 539 | CCCN{8}ACC | 58 | 31 | 0.44 | 881 |

TABLE 7-continued

Dyad patterns over-represented in STAR elements. The patterns are ranked according to significance coefficient. These were determined using RSA-Tools with the random sequence from the human genome as reference. Patterns that comprise the most discriminant variables in Linear Discriminant Analysis are indicated with an asterisk. (SEQ ID NOS:343-1072)

| Number | Dyad sequence | Observed occurrences | Expected occurrences | Significance coefficient | SEQ ID NO: |
|---|---|---|---|---|---|
| 540 | CAGN{15}GCC | 77 | 44 | 0.44 | 882 |
| 541 | CCCN{17}CGG | 24 | 8 | 0.44 | 883 |
| 542 | GCGN{1}CCA | 22 | 7 | 0.44 | 884 |
| 543 | CCCN{14}CAG | 79 | 46 | 0.44 | 885 |
| 544 | CCCN{8}CCC | 89 | 53 | 0.44 | 886 |
| 545 | ACAN{12}GCG | 23 | 8 | 0.43 | 887 |
| 546 | AGGN{4}CCG | 23 | 8 | 0.43 | 888 |
| 547 | CGCN{13}GCC | 23 | 8 | 0.43 | 889 |
| 548 | GAGN{2}CGC | 23 | 8 | 0.42 | 890 |
| 549 | CCCN{9}GCG | 21 | 7 | 0.42 | 891 |
| 550 | CGCN{17}ACA | 17 | 5 | 0.42 | 892 |
| 551 | GCGN{17}CCA | 23 | 8 | 0.42 | 893 |
| 552 | AAGN{18}CCG | 20 | 6 | 0.42 | 894 |
| 553 | CGCN{1}GGA | 18 | 5 | 0.41 | 895 |
| 554 | CCAN{1}CCC | 90 | 54 | 0.41 | 896 |
| 555 | CGTN{18}TGC | 20 | 6 | 0.41 | 897 |
| 556 | TCCN{14}CGA | 17 | 5 | 0.41 | 898 |
| 557 | CACN{5}GGG | 56 | 29 | 0.4 | 899 |
| 558 | CCGN{12}GCA | 21 | 7 | 0.4 | 900 |
| 559 | CTGN{6}CCC | 77 | 44 | 0.4 | 901 |
| 560 | CGGN{8}GGC | 32 | 13 | 0.4 | 902 |
| 561 | CCAN{11}GGG | 68 | 38 | 0.4 | 903 |
| 562 | ACGN{19}CAA | 21 | 7 | 0.39 | 904 |
| 563 | GGGN{20}CCC | 72 | 31 | 0.39 | 905 |
| 564 | CGCN{3}CAG | 23 | 8 | 0.39 | 906 |
| 565 | AGCN{17}GGG | 58 | 31 | 0.37 | 907 |
| 566 | CACN{20}CCG | 21 | 7 | 0.37 | 908 |
| 567 | ACGN{17}CAG | 24 | 8 | 0.37 | 909 |
| 568 | AGGN{1}CCC | 60 | 32 | 0.37 | 910 |
| 569 | CGTN{12}CAC | 20 | 6 | 0.37 | 911 |
| 570 | CGGN{9}GGC | 23 | 8 | 0.37 | 912 |
| 571 | CGCN{10}GCG | 18 | 3 | 0.37 | 913 |
| 572 | CCCN{6}CTC | 80 | 47 | 0.36 | 914 |
| 573 | CCGN{10}AGG | 23 | 8 | 0.36 | 915 |
| 574 | CCCN{18}CAG | 79 | 46 | 0.36 | 916 |
| 575 | AGCN{17}CCG | 21 | 7 | 0.36 | 917 |
| 576 | AGCN{9}GCG | 18 | 5 | 0.36 | 918 |
| 577 | CCAN{3}GGC | 62 | 34 | 0.36 | 919 |
| 578 | CCCN{11}GGC | 57 | 30 | 0.35 | 920 |
| 579 | ACGN{5}GCA | 23 | 8 | 0.35 | 921 |
| 580 | CCCN{14}CGG | 23 | 8 | 0.35 | 922 |
| 581 | CCCN{5}CCA | 91 | 55 | 0.35 | 923 |
| 582 | CCGN{1}AGG | 22 | 7 | 0.34 | 924 |
| 583 | GGGN{10}GAC | 45 | 22 | 0.34 | 925 |
| 584 | CGCN{15}CCA | 20 | 6 | 0.34 | 926 |
| 585 | CCTN{19}CGC | 22 | 7 | 0.34 | 927 |
| 586 | CGTN{3}CGC | 10 | 2 | 0.33 | 928 |
| 587 | AGCN{14}CCG | 21 | 7 | 0.33 | 929 |
| 588 | GGCN{2}CGA | 17 | 5 | 0.33 | 930 |
| 589 | CAGN{8}CCC | 79 | 46 | 0.33 | 931 |
| 590 | CCGN{2}GAC | 16 | 4 | 0.33 | 932 |
| 591 | AGCN{19}AGG | 70 | 40 | 0.32 | 933 |
| 592 | CCTN{4}GGC | 64 | 35 | 0.32 | 934 |
| 593 | CCGN{11}AGC | 22 | 7 | 0.32 | 935 |
| 594 | CACN{4}CGC | 18 | 5 | 0.32 | 936 |
| 595 | CCGN{1}CCC | 30 | 12 | 0.31 | 937 |
| 596 | CTGN{13}GGC | 73 | 42 | 0.31 | 938 |
| 597 | CGCN{16}ACC | 15 | 4 | 0.31 | 939 |
| 598 | CACN{18}CAG | 79 | 46 | 0.31 | 940 |
| 599 | GGCN{8}GCC | 68 | 29 | 0.29 | 941 |
| 600 | GGGN{15}GGA | 78 | 46 | 0.29 | 942 |
| 601 | CCGN{16}GCC | 22 | 7 | 0.29 | 943 |
| 602 | CCGN{20}ACC | 18 | 5 | 0.29 | 944 |
| 603 | CGAN{7}CCC | 17 | 5 | 0.28 | 945 |
| 604 | CCGN{6}CTC | 23 | 8 | 0.28 | 946 |
| 605 | CGGN{10}CTC | 22 | 7 | 0.28 | 947 |
| 606 | CAGN{16}CGC | 23 | 8 | 0.28 | 948 |
| 607 | CCAN{3}AGG | 77 | 45 | 0.27 | 949 |
| 608 | GCCN{18}GCC | 52 | 27 | 0.27 | 950 |
| 609 | CGCN{18}GGA | 19 | 6 | 0.26 | 951 |

TABLE 7-continued

Dyad patterns over-represented in STAR elements. The patterns are ranked according to significance coefficient. These were determined using RSA-Tools with the random sequence from the human genome as reference. Patterns that comprise the most discriminant variables in Linear Discriminant Analysis are indicated with an asterisk. (SEQ ID NOS:343-1072)

| Number | Dyad sequence | Observed occurrences | Expected occurrences | Significance coefficient | SEQ ID NO: |
|---|---|---|---|---|---|
| 610 | CCGN{20}GGC | 22 | 7 | 0.26 | 952 |
| 611 | ACAN{10}GCG | 17 | 5 | 0.26 | 953 |
| 612 | CGGN{5}CCC | 25 | 9 | 0.25 | 954 |
| 613 | CCCN{7}TCC | 75 | 43 | 0.25 | 955 |
| 614 | ACGN{10}CGC | 10 | 2 | 0.25 | 956 |
| 615 | CCCN{3}TCC | 81 | 48 | 0.25 | 957 |
| 616 | CCGN{8}CGG | 20 | 3 | 0.24 | 958 |
| 617 | CCAN{15}CGG | 22 | 7 | 0.24 | 959 |
| 618 | CCGN{6}CCG | 17 | 5 | 0.24 | 960 |
| 619 | CAGN{3}GCG | 25 | 9 | 0.24 | 961 |
| 620 | GAGN{1}CCC | 62 | 34 | 0.24 | 962 |
| 621 | CCGN{18}TGC | 22 | 7 | 0.23 | 963 |
| 622 | CCCN{7}CCA | 85 | 51 | 0.23 | 964 |
| 623 | CGGN{3}CCA | 24 | 9 | 0.23 | 965 |
| 624 | ACGN{1}CCC | 18 | 5 | 0.23 | 966 |
| 625 | CGGN{13}TGA | 21 | 7 | 0.22 | 967 |
| 626 | CTCN{6}GGC | 53 | 28 | 0.22 | 968 |
| 627 | GCGN{2}GAC | 15 | 4 | 0.22 | 969 |
| 628 | GGGN{11}ACC | 49 | 25 | 0.22 | 970 |
| 629 | CGCN{4}GGA | 17 | 5 | 0.22 | 971 |
| 630 | CCCN{11}CCG | 27 | 10 | 0.22 | 972 |
| 631 | CCGN{19}GCA | 20 | 6 | 0.22 | 973 |
| 632 | GCGN{0}GCA | 20 | 6 | 0.21 | 974 |
| 633 | AGAN{7}CCC | 61 | 33 | 0.21 | 975 |
| 634 | CGGN{2}CCA | 21 | 7 | 0.21 | 976 |
| 635 | CCCN{7}CCC | 89 | 54 | 0.21 | 977 |
| 636 | ACCN{4}GCG | 15 | 4 | 0.2 | 978 |
| 637 | CCTN{15}CGC | 20 | 6 | 0.2 | 979 |
| 638 | AGCN{9}GTC | 44 | 21 | 0.2 | 980 |
| 639 | CCCN{18}CTC | 74 | 43 | 0.2 | 981 |
| 640 | CGCN{18}CGA | 9 | 1 | 0.19 | 982 |
| 641 | CCCN{15}GCC | 62 | 34 | 0.18 | 983 |
| 642 | ACCN{11}GGC | 45 | 22 | 0.18 | 984 |
| 643 | AGGN{15}CGC | 29 | 12 | 0.18 | 985 |
| 644 | GCGN{0}CCA | 27 | 10 | 0.18 | 986 |
| 645 | GCGN{9}AGC | 18 | 5 | 0.17 | 987 |
| 646 | GGGN{18}GCA | 59 | 32 | 0.17 | 988 |
| 647 | CCCN{17}CAG | 77 | 45 | 0.17 | 989 |
| 648 | CCAN{8}CGG | 22 | 8 | 0.16 | 990 |
| 649 | CCGN{10}GGC | 21 | 7 | 0.16 | 991 |
| 650 | GCAN{0}GCC | 76 | 44 | 0.16 | 992 |
| 651 | CAGN{2}CGC | 20 | 6 | 0.16 | 993 |
| 652 | CGCN{8}GGC | 19 | 6 | 0.16 | 994 |
| 653 | CTGN{17}GGC | 65 | 36 | 0.16 | 995 |
| 654 | GGGN{14}ACC | 46 | 23 | 0.16 | 996 |
| 655 | CCGN{1}TGC | 20 | 6 | 0.16 | 997 |
| 656 | CAGN{8}CGC | 22 | 8 | 0.15 | 998 |
| 657 | AAGN{11}CGC | 17 | 5 | 0.15 | 999 |
| 658 | CCGN{6}TCC | 22 | 8 | 0.14 | 1000 |
| 659 | CCAN{18}CCC | 72 | 42 | 0.14 | 1001 |
| 660 | CCAN{0}CCC | 84 | 51 | 0.14 | 1002 |
| 661 | GAGN{6}CCC | 53 | 28 | 0.14 | 1003 |
| 662 | AGCN{20}GGC | 52 | 27 | 0.14 | 1004 |
| 663 | CAGN{0}CGC | 21 | 7 | 0.14 | 1005 |
| 664 | CCGN{12}CTC | 22 | 8 | 0.14 | 1006 |
| 665 | CGCN{15}ACG | 9 | 1 | 0.13 | 1007 |
| 666 | GGCN{17}CGA | 15 | 4 | 0.13 | 1008 |
| 667 | CCGN{16}AAG | 19 | 6 | 0.13 | 1009 |
| 668 | CGCN{14}TCC | 19 | 6 | 0.12 | 1010 |
| 669 | AGGN{7}CGC | 20 | 7 | 0.12 | 1011 |
| 670 | CGGN{7}CCC | 22 | 8 | 0.12 | 1012 |
| 671 | CGCN{4}GCC | 34 | 15 | 0.12 | 1013 |
| 672 | CGAN{6}CCC | 17 | 5 | 0.12 | 1014 |
| 673 | CCCN{19}GGA | 60 | 33 | 0.11 | 1015 |
| 674 | CCCN{16}GCG | 28 | 11 | 0.11 | 1016 |
| 675 | CCAN{7}CGC | 20 | 7 | 0.11 | 1017 |
| 676 | CCCN{6}GCC | 80 | 48 | 0.11 | 1018 |
| 677 | GCCN{14}TCC | 55 | 29 | 0.11 | 1019 |
| 678 | AGGN{14}GCC | 64 | 36 | 0.1 | 1020 |
| 679 | CGCN{11}GCC | 20 | 7 | 0.1 | 1021 |

TABLE 7-continued

Dyad patterns over-represented in STAR elements. The patterns are ranked according to significance coefficient. These were determined using RSA-Tools with the random sequence from the human genome as reference. Patterns that comprise the most discriminant variables in Linear Discriminant Analysis are indicated with an asterisk. (SEQ ID NOS:343-1072)

| Number | Dyad sequence | Observed occurrences | Expected occurrences | Significance coefficient | SEQ ID NO: |
|---|---|---|---|---|---|
| 680 | TCCN{0}GCA | 17 | 5 | 0.09 | 1022 |
| 681 | GCGN{8}CCC | 27 | 11 | 0.09 | 1023 |
| 682 | CCAN{11}GCG | 19 | 6 | 0.09 | 1024 |
| 683 | CACN{4}GGG | 51 | 26 | 0.09 | 1025 |
| 684 | CGGN{7}TCC | 20 | 7 | 0.09 | 1026 |
| 685 | GCGN{5}GCC | 20 | 7 | 0.09 | 1027 |
| 686 | ACGN{12}CAG | 26 | 10 | 0.09 | 1028 |
| 687 | CCGN{19}CGC | 14 | 4 | 0.08 | 1029 |
| 688 | CGGN{8}TGC | 18 | 5 | 0.08 | 1030 |
| 689 | CCCN{1}GAG | 65 | 37 | 0.07 | 1031 |
| 690 | GCGN{19}TGA | 18 | 6 | 0.07 | 1032 |
| 691 | GGCN{15}GCC | 70 | 31 | 0.07 | 1033 |
| 692 | CCGN{7}CCC | 27 | 11 | 0.07 | 1034 |
| 693 | ACAN{19}CCC | 63 | 35 | 0.07 | 1035 |
| 694 | ACCN{16}GGG | 47 | 24 | 0.07 | 1036 |
| 695 | AGAN{1}GGC | 64 | 36 | 0.07 | 1037 |
| 696 | GGGN{17}TGA | 64 | 36 | 0.06 | 1038 |
| 697 | CAGN{5}GGG | 83 | 50 | 0.06 | 1039 |
| 698 | GCCN{13}CGC | 22 | 8 | 0.06 | 1040 |
| 699 | GCGN{7}GGA | 19 | 6 | 0.06 | 1041 |
| 700 | CAGN{14}CCA | 94 | 58 | 0.06 | 1042 |
| 701 | CCGN{4}GTC | 16 | 4 | 0.06 | 1043 |
| 702 | CCCN{13}CGC | 22 | 8 | 0.06 | 1044 |
| 703 | GCGN{14}ACC | 15 | 4 | 0.05 | 1045 |
| 704 | CAGN{20}GGG | 81 | 49 | 0.05 | 1046 |
| 705 | CCGN{4}CCC | 27 | 11 | 0.05 | 1047 |
| 706 | CGCN{5}GGC | 18 | 6 | 0.05 | 1048 |
| 707 | CCTN{6}GGC | 57 | 31 | 0.05 | 1049 |
| 708 | AGGN{3}GGC | 67 | 38 | 0.05 | 1050 |
| 709 | CGGN{11}CGC | 14 | 4 | 0.05 | 1051 |
| 710 | CTGN{18}GGA | 77 | 46 | 0.04 | 1052 |
| 711 | CACN{17}CCA | 74 | 43 | 0.04 | 1053 |
| 712 | CGGN{3}GAG | 22 | 8 | 0.04 | 1054 |
| 713 | CCCN{9}CCA | 82 | 49 | 0.03 | 1055 |
| 714 | CCCN{1}ACG | 18 | 6 | 0.03 | 1056 |
| 715 | CAGN{1}GCC | 72 | 42 | 0.03 | 1057 |
| 716 | AGGN{6}CCG | 23 | 8 | 0.03 | 1058 |
| 717 | AGCN{9}GGG | 57 | 31 | 0.03 | 1059 |
| 718 | CCCN{7}GGC | 54 | 29 | 0.02 | 1060 |
| 719 | CCTN{13}CCC | 88 | 54 | 0.02 | 1061 |
| 720 | CCGN{19}TTC | 20 | 7 | 0.02 | 1062 |
| 721 | CCCN{7}CCG | 27 | 11 | 0.02 | 1063 |
| 722 | CGAN{6}GGC | 17 | 5 | 0.01 | 1064 |
| 723 | CGGN{4}CTC | 21 | 7 | 0.01 | 1065 |
| 724 | CGGN{0}CGC | 13 | 3 | 0.01 | 1066 |
| 725 | CCTN{13}ACG | 19 | 6 | 0.01 | 1067 |
| 726 | GGGN{6}CAC | 53 | 28 | 0.01 | 1068 |
| 121 | CCCN{16}CGC | 21 | 7 | 0.01 | 1069 |
| 728 | CCCN{10}CTC | 76 | 45 | 0 | 1070 |
| 729 | CCCN{0}CAG | 92 | 57 | 0 | 1071 |
| 730 | GCCN{5}CCC | 65 | 37 | 0 | 1072 |

TABLE 8

Candidate STAR elements tested by Linear Discriminant Analysis (SEQ ID NOS: 66-84)

| SEQ ID NO: | Candidate STAR | Location[1] | Length |
|---|---|---|---|
| 66 | T2 F | 20q13.33 | ~2800 |
| 67 | T2 R | 6q14.1 | ~2800 |
| 68 | T3 F | 15q12 | ~2900 |
| 69 | T3 R | 7q31.2 | ~2900 |
| 70 | T5 F | 9q34.13 | ND[2] |
| 71 | T5 R | 9q34.13 | ND |
| 72 | T7 | 22q12.3 | ~1200 |
| 73 | T9 F | 21q22.2 | ~1600 |
| 74 | T9 R | 22q11.22 | ~1600 |
| 75 | T10 F | 7q22.2 | ~1300 |
| 76 | T10 R | 6q14.1 | ~1300 |
| 77 | T11 F | 17q23.3 | ~2000 |
| 78 | T11 R | 16q23.1 | ~2000 |
| 79 | T12 | 4p15.1 | ~2100 |

TABLE 8-continued

Candidate STAR elements tested by Linear Discriminant Analysis (SEQ ID NOS: 66-84)

| SEQ ID NO: | Candidate STAR | Location[1] | Length |
|---|---|---|---|
| 80 | T13 F | 20p13 | ~1700 |
| 81 | T13 R | 1p13.3 | ~1700 |
| 82 | T14 R | 11q25 | ~1500 |
| 83 | T17 | 2q31.3 | ND |
| 84 | T18 | 2q31.1 | ND |

[1]Chromosomal location is determined by BLAT search of DNA sequence data from the STAR elements against the human genome database. The location is given according to standard nomenclature referring to the cytogeneticideogram of each chromosome; e.g., 1p2.3 is the third cytogenetic sub-band of the second cytogenetic band of the short arm of chromosome 1ncbi.nlm.nih.gov/Class/MLACourse/Genetics/chrombanding.html). F, forward sequencing reaction result; R, reverse sequencing reaction result. When the forward and reverse sequencing resultsmapped to different genomic locations, each sequence was extended to the full length of the original clone (as determined by restriction mapping) based on sequence information from the human genome database.
[2]ND: Not Determined.

TABLE 9

Arabidopsis STAR elements of the invention, including chromosome location and length (SEQ ID NOS: 85-119)

| STAR | Chromosome | Length, kb | SEQ ID NO: |
|---|---|---|---|
| A1 | I | 1.2 | 85 |
| A2 | I | 0.9 | 86 |
| A3 | I | 0.9 | 87 |
| A4 | I | 0.8 | 88 |
| A5 | I | 1.3 | 89 |
| A6 | I | 1.4 | 90 |
| A7 | II | 1.2 | 91 |
| A8 | II | 0.8 | 92 |
| A9 | II | 0.9 | 93 |
| A10 | II | 1.7 | 94 |
| A11 | II | 1.9 | 95 |
| A12 | II | 1.4 | 96 |
| A13 | II | 1.2 | 97 |
| A14 | II | 2.1 | 98 |
| A15 | II | 1.4 | 99 |
| A16 | II | 0.7 | 100 |
| A17 | II | 1.5 | 101 |
| A18 | III | 1.5 | 102 |
| A19 | III | 0.7 | 103 |
| A20 | III | 2.0 | 104 |
| A21 | IV | 1.8 | 105 |
| A22 | IV | 0.8 | 106 |
| A23 | IV | 0.6 | 107 |
| A24 | IV | 0.5 | 108 |
| A25 | V | 0.9 | 109 |
| A26 | V | 1.9 | 110 |
| A27 | V | 1.1 | 111 |
| A28 | V | 1.6 | 112 |
| A29 | V | 0.9 | 113 |
| A30 | V | 2.0 | 114 |
| A31 | V | 2.0 | 115 |
| A32 | V | 1.3 | 116 |
| A33 | V | 0.9 | 117 |
| A34 | I | 0.9 | 118 |
| A35 | II | 1.1 | 119 |

REFERENCES

Altschul S. F., Gish W., Miller W., Myers E. W. and Lipman D. J. (1990) Basic local alignment search tool. *J. Mol. Biol.* 215, 403-10.

Bell A. C., West A. G. and Felsenfeld G. (2001) Insulators and boundaries: versatile regulatory elements in the eukaryotic genome. *Science* 291, 447-50.

Berger J., Hauber J., Hauber R., Geiger R. and Cullen B. R. (1988) Secreted placental alkaline phosphatase: a powerful new quantitative indicator of gene expression in eukaryotic cells. *Gene* 66,1-10.

Bevan M., Mayer K., White O., Eisen J. A., Preuss D., Bureau T., Salzberg S. L. and Mewes H. W. (2001) Sequence and analysis of the *Arabidopsis* genome. *Curr. Opin. Plant Biol.* 4,105-10.

Bibel M. and Barde Y. A. (2000) Neurotrophins: key regulators of cell fate and cell shape in the vertebrate nervous system. *Genes Dev.* 14, 2919-37.

Boivin A. and Dura J. M. (1998) In vivo chromatin accessibility correlates with gene silencing in *Drosophila*. *Genetics* 150, 1539-49.

Boshart M., Weber F., Jahn G., Dorsch-Hasler K., Fleckenstein B. and Schaffner W. (1985) A very strong enhancer is located upstream of an immediate early gene of human cytomegalovirus. *Cell* 41, 521-30.

Bunker C. A. and Kingston R. E. (1994) Transcriptional repression by *Drosophila* and mammalian Polycomb group proteins in transfected mammalian cells. *Mol. Cell. Biol.* 14, 1721-32.

Chung J. H, Whiteley M. and Felsenfeld G. (1993) A 5' element of the chicken beta-globin domain serves as an insulator in human erythroid cells and protects against position effect in *Drosophila*. *Cell* 74, 505-14.

Deuschle U., Meyer W. K. and Thiesen H. J. (1995) Tetracycline-reversible silencing of eukaryotic promoters. *Mol. Cell. Biol.* 15, 1907-14.

Doll R. F., Crandall J. E., Dyer C. A., Aucoin J. M. and Smith F. I. (1996) Comparison of promoter strengths on gene delivery into mammalian brain cells using AAV vectors. *Gene Ther.* 3, 437-447.

Foecking M. K. and Hofstetter H. (1986) Powerful and versatile enhancer-promoter unit for mammalian expression vectors. *Gene* 45, 101-5.

Garrick D., Fiering S., Martin D. I. and Whitelaw E. (1998) Repeat-induced gene silencing in mammals. *Nat. Genet.* 18, 56-9.

Gerasimova T. I. and Corces V. G. (2001) Chromatin insulators and boundaries: effects on transcription and nuclear organization. *Annu. Rev. Genet.* 35, 193-208.

Gossen M. and Bujard H. (1992) Tight control of gene expression in mammalian cells by tetracycline-responsive promoters. *Proc. Natl. Acad. Sci. U.S.A.* 89, 5547-51.

Graham F. L. and van der Eb A. J. (1973) Transformation of rat cells by DNA of human adenovirus 5. *Virology* 54, 536-9.

Henthorn P., Zervos P., Raducha M., Harris H. and Kadesch T. (1988) Expression of a human placental alkaline phosphatase gene in transfected cells: use as a reporter for studies of gene expression. *Proc. Natl. Acad. Sci. U.S.A.* 85, 6342-6.

Himes S. R. and Shannon M. F. (2000) Assays for transcriptional activity based on the luciferase reporter gene. *Methods Mol. Biol.* 130, 165-74.

Huberty C. J. (1994) Applied discriminant analysis, Wiley and Sons, New York.

Initiative A. G. (2000) Analysis of the genome sequence of the flowering plant *Arabidopsis thaliana*. *Nature* 408, 796-815.

Izumi M. and Gilbert D. M. (1999) Homogeneous tetracycline-regulatable gene expression in mammalian fibroblasts. *J. Cell. Biochem.* 76, 280-9.

Kain S. R. (1997) Use of secreted alkaline phosphatase as a reporter of gene expression in mammalian cells. *Methods Mol. Biol.* 63, 49-60.

Kaufman R. J. (1990) Selection and coamplification of heterologous genes in mammalian cells. *Methods in Enzymology* 185, 536-566.

Kellum R. and Schedl P. (1992) A group of scs elements function as domain boundaries in an enhancer-blocking assay. *Mol. Cell. Biol.* 12, 2424-2431.

Kent W. J. (2002) BLAT—the BLAST-like alignment tool. *Genome Res.* 12, 656-64.

Knofler M., Meinhardt G., Bauer S., Loregger T., Vasicek R., Bloor D. J., Kimber S. J. and Husslein P. (2002) Human Hand1 basic helix-loop-helix (bHLH) protein: extra-embryonic expression pattern, interaction partners and identification of its transcriptional repressor domains. *Biochem J.* 361, 641-51.

Meyer P. (2000) Transcriptional transgene silencing and chromatin components. *Plant Mol. Biol.* 43, 221-34.

Mercenier A., Wiedermann U. and Breiteneder H. (2001) Edible genetically modified microorganisms and plants for improved health. *Curr. Opin. Biotechnol.* 12, 510-5.

Morgenstern J. P. and Land H. (1990) Advanced mammalian gene transfer: high titre retroviral vectors with multiple drug selection markers and a complementary helper-free packaging cell line. *Nucleic Acids Res.* 18, 3587-96.

Sambrook J., Fritsch E. F. and Maniatis T. (1989) *Molecular Cloning: A Laboratory Manual*, Second ed., Cold Spring Harbor Laboratory Press, Plainview N.Y.

Sanger F., Nicklen S. and Coulson A. R. (1977) DNA sequencing with chain-terminating inhibitors. *Proc. Natl. Acad. Sci. U.S.A.* 74, 5463-7.

Stam M., Viterbo A., Mol J. N. and Kooter J. M. (1998) Position-dependent methylation and transcriptional silencing of transgenes in inverted T-DNA repeats: implications for posttranscriptional silencing of homologous host genes in plants. *Mol. Cell. Biol.* 18, 6165-77.

Umana P., Jean-Mairet J. and Bailey J. E. (1999) Tetracycline-regulated overexpression of glycosyltransferases in Chinese hamster ovary cells. *Biotechnol. Bioeng.* 65, 542-9.

Van der Vlag J., den Blaauwen J. L., Sewalt R. G., van Driel R. and Otte A. P. (2000) Transcriptional repression mediated by polycomb group proteins and other chromatin-associated repressors is selectively blocked by insulators. *J. Biol. Chem.* 275, 697-704.

van Helden J., Andre B. and Collado-Vides J. (1998) Extracting regulatory sites from the upstream region of yeast genes by computational analysis of oligonucleotide frequencies *J. Mol. Biol.* 281, 827-42.

van Helden J., Andre B. and Collado-Vides J. (2000) A web site for the computational analysis of yeast regulatory sequences. *Yeast* 16, 177-87.

van Helden J., Rios A. F. and Collado-Vides J. (2000) Discovering regulatory elements in non-coding sequences by analysis of spaced dyads. *Nucleic Acids Res.* 28, 1808-18.

Vance V. and Vaucheret H. (2001) RNA silencing in plants—defense and counterdefense. *Science* 292, 2277-80.

Wigler M., Pellicer A., Silverstein S. and Axel R. (1978) Biochemical transfer of single-copy eucaryotic genes using total cellular DNA as donor. *Cell* 14, 725-31.

Yang T. T., Sinai P., Kitts P. A. and Kain S. R. (1997) Quantification of gene expression with a secreted alkaline phosphatase reporter system. *Biotechniques* 23, 1110-4.

Zink D. and Paro R. (1995) *Drosophila* Polycomb-group regulated chromatin inhibits the accessibility of a transactivator to its target DNA. *Embo. J.* 14, 5660-71.

SEQUENCE LISTING (1072 sequences)

SEQ ID NO: 1 - DNA, 749 bp, Artificial Sequence
  sequence of STAR1
atgcggtgggggcgcgccagagactcgtgggatccttggcttggatgtttggatctttctgagttgcctgtgccgcgaaagacaggtacatttctgattaggcctgtgaagcctcctggaggaccatctcattaagacgatggtattggagggagagtcacagaaagaactgtggcccctccctcactgcaaaacggaagtgattttattttaatgggagttggaatatgtgagggctgcaggaaccagtctccctccttcttggttggaaaagctggggctggcctcagagacaggttttttggccccgctgggctgggcagtctagtcgaccctttgtagactgtgcacacccctagaagagcaactacccctatacaccaggctggctcaagtgaaaggggctctgggctccagtctggaaaatctggtgtcctggggacctctggtcttgcttctctcctcccctgcactggctctgggtgcttatctctgcagaagcttctcgctagcaaacccacattcagcgccctgtagctgaacacagcacaaaaagccctagagatcaaaagcattagtatgggcagttgagcgggaggtgaatatttaacgcttttgttcatcaataactcgttggctttgacctgtctgaacaagtcgagcaataaggtgaaatgcaggtcacagcgtctaacaaatatgaaaatgtgtatattcaccccggtctccagccggcgcgccaggctccc

SEQ ID NO: 2 - DNA, 883 bp, Artificial Sequence
  sequence of STAR2
gggtgcttcctgaattcttccctgagaaggatggtggccggtaaggtccgtgtaggtggggtgcggctccccaggccccggcccgtggtggtggccgctgcccagcggcccggcacccccatagtccatggcgcccgaggcagcgtgggggaggtgagttagaccaaagagggctggcccggagttgctcatgggctccacatagctgccccccacgaagacggggcttccctgtatgtgtggggtcccatagctgccgttgccctgcaggccatgagcgtgcgggtcatagtcgggggtgccccctgcgcccgcccctgccgccgtgtagcgcttctgtgggggtggcgggggtgcgcagctgggcagggacgcagggtaggaggcggggggcagcccgtaggtaccctgggggggcttggagaagggcgggggcgactggggctcatacgggacgctgttgaccagcgaatgcatagagttcagatagccaccggctccggggggcacggggctgcgacttggagactggccccccgatgacgttagcatgcccttgcccttctgatcctttttgtacttcatgcggcgattctggaaccagatcttgatctggcgctcagtgaggttcagcagattggccatctccacccggcgcggccggcacaggtagcggttgaagtggaactctttctccagctccaccagctgcgcgctcgtgtaggccgtgcgcgcgcgcttggacgaagcctgccccggcgggctcttgtcgccagcgcagctttcgcctgcgaggacagagagaggaagagcggcgtcaggggctgccgcggccccgcccagcccctgacccagcccggcccctccttccaccaggccccaa

SEQ ID NO: 3 - DNA, 2126 bp, Artificial Sequence
  sequence of STAR3
atctcgagtactgaaataggagtaaatctgaagagcaaataagatgagccagaaaaccatgaaaagaacagggactaccagttgattccacaaggacattcccaaggtgagaaggccatatacctccactacctgaaccaattctctgtatgcagatttagcaaggttataaggtagcaaaagattagacccaagaaaatagagaacttccaatccagtaaaaatcatagcaaatttattgatgataacaattgtctccaaaggaacaaggcagagtcgtgctagcagaggaagcacgtgagctgaaaacagccaaatctgctttgttttcatgacacaggagcataaagtacacaccaccaactgacctattaaggctgtggtaaaccgattcatagagagaggttctaaatacattggtccctcacaggcaaactgcagttcgctccgaacgtagtccctggaaatttgatgtccagtatagaaaagcagagcagtcaaaaaatatagataaagctgaaccagatgttgcctgggcaatgttagcagcaccacacttaagatataacctcaggctgtggactccctccctggggagcggtgctgccggcggcgggcgggctccgcaactccccggctctctcgcccgccctcccgttctcctcgggcggcggcgggggccgggactgcgccgctcacagcggcggctcttctgcgcccggcctcggaggcagtggcggtggcggccatggcctcctgcgttcgccgatgtcagcatttcgaactgagggtcatctccttgggactggttagacagtgggtgcagcccacggagggcgagttgaagcagggtggggtgtcacctcccccaggaagtccagtgggtcagggaactccctcccctagccaagggaggccgtgagggactgtgcccggtgagagactgtgccctgaggaaaggtgcactctggcccagatactacacttttcccacggtcttcaaaacccgcagaccaggagattccctcgggttcctacaccaccaggaccctgggtttcaaccacaaaaccgggccatttgggcagacacccagctagctgcaagagttgtttttttttttatactcctgtggcacctggaacgccagcgagagagcacctttcactcccctggaaagggggctgaaggcagggacctttagctgcgggctagggggtttggggttgagtgggggaggggagagggaaaaggcctcgtcattggcgtcgtctgcagccaataaggctacgctcctctgctgcgagtagacccaatcctttcctagaggtggagggggcgggtaggtggaagtagaggtggcgcggtatctaggagagagaaaaagggctggaccaataggtgcccggaagaggcggacccagcggtctgttgattggtattggcagtggaccctcccccggggtggtgccggagggggggatgatgggtcgaggggtgtgtttatgtggaagcgagatgaccggcaggaacctgccccaatgggctgcagagtggttagtgagtgggtgacagacagacccgtaggccaacgggtggccttaagtgtctttggtctcctccaatggagcagcggcggggcgggaccgcgactcgggtttaatgagactccattgggctgtaatcagtgtcatgtcggattcatgtcaacgacaacaacagggggacacaaaatggcggcggcttagtcctacccctggcggcggcggcagcggtggcggaggcgacggcactcctccaggcggcagccgcagtttctcaggcagcggcagcgcccccggcaggcgcggtggcggtggcgcgcagccaggtctgtcacccaccccgcgcgttcccagggggaggagactgggcgggaggggggaacagacggggggggattcaggggcttgcgacgcccctcccacaggcctctgcgcgagggtcaccgcggggccgctcggggtcaggctgcccctgagcgtgacggtagggggcgggggaaaggggaggagggacaggccccgcccctcggcagggcctctagggcaagggggcggggctcgaggagcggaggggggcggggcgg

SEQ ID NO: 4 - DNA, 1625 bp, Artificial Sequence
  sequence of STAR4
gatctgagtcatgttttaaggggaggattcttttggctgctgagttgagattaggttgagggtagtgaaggtaaaggcagtgagaccacgtaggggtcattgcagtaatccaggctggagatgatggtggttcagttggaatagcagtgcatgtgctgtaacaacctcagctgggaagcagtatatgtggcgttatgacctcagctggaacagcaatgcatgtggtggtgtaatgaccccagctgggtagggtgcatgtggtgtaacgacctcagctgggtagcagtgtgtgtgatgtaacaacctcagctgggtagcagtgtacttgataaaatgttggcatactctagatttgttatgagggtagtgccattaaatttctccacaaattggttgtcacgtatgagtgaaaagaggaagtgatggaagacttcagtgcttttggcctgaataaatagaagacgtcatttccagttaatggagacagggaagactaaaggtagggtgggattcagtagagcaggtgttcagttttgaatatgatgaactctgagagaggaaaaactttttctacctcttagtttttgtgactggacttaagaattaaagtgacataagacagagtaacaagacaaaaatatgcgaggttatttaatatttttacttgcagaggggaatcttcaaaagaaaaatgaagacccaaagaagccattagggtcaaaagctcatatgcctttttaagtagaaaatgataaattttaacaatgtgagaagacaaaggtgtttgagctgagggcaataaattgtgggacagtgattaagaaatatatgggggaaatgaaatgataagttattttagtagatttattcttcatatctattttggcttcaacttccagtctctagtgataagaatgttcttctcttcctggtacagagagagcacctttctcatgggaaattttatgaccttgctgtaagtagaaaggggaagatcgatctcctgtttcccagcatcaggatgcaaacatttccctccattccagttctcaaccccatggctgggcctcatggcattccagcatcgctatgagtgcacctttcctgcaggctgcctcgggtagctggtgcactgctaggtcagtctatgtgaccaggagctgggcctctgggcaatgccagttggcagcccccatccctccactgctgggggcctcctatccagaagggcttggtgtgcagaacgatggtgcaccatcatcattccccacttgccatctttcaggggacagccagctgctttgggcgcggcaaaaaacacccaactcactcctcttcaggggcctctggtctgatgccaccacaggacatccttgagtgctgggcagtctgaggacagggaaggagtgatgaccacaaaacaggaatggcagcagcagtgacaggaggaagtcaaaggcttgtgtgtcctggccctgctgagggctggcgagggccctgggatggcgctcagtgcctggtcggctgcaagaggccagccctctgcccatgaggggagctggcagtgaccaagctgcactgccctggtggtgcatttcctgccccactctttccttctaagatcc

SEQ ID NO: 5 - DNA, 1571 bp, Artificial Sequence
  sequence of STAR5
agcagagatcttatttcccgtattcccttgtggcacagcacctcccacgccaaagcaaaccaaagcaaaggagcccttgatgaggaggggccttcccccaacctggtctcccacaggtcctacatacgtacccaccccagacacacagagctgcttcctgctctcacaccagactgagctgtgcccagacatttcccctagcactaaccaactctttcaaaaatacatttttctctaaaaagaacaagtttaaacaaagttgactcattttaagaactgtttagaagataaccttgtgtttattaattatgtatttgcagaaattggaggcagaaggttaccaacattgcctggtgtccagccaggaggtagagcgtggtggcatccagaaccttcctccaactcctgcctggcgtggtttttattcatctttgtattcccaagaaacttctcagtgtctcaggagtgttaggcactcagtacgtgtttggtagttacatgaatgaatgcataatgactaagtgagttaatggatgaagctaattgtctctcccttttgcttttccagagctttccaaggtgaaagtgttggacactctttcttcatctcagatttaatcaactaagaatgctgcaaattgaacaccagtccacaaaactcaggaatacatgaaaagcattgtgccttatttttaactaactcaaattctatgtcagtctcccttttatgctggatgttggcgctaaatctcagtgggttcctcattctgccagacctgtgtccagtttgggggcttcacatagagccaccccatcacaggagagggaagggtcttgctcttggttgccatcactccaccctcttgtcttccgagctttgatgttcactttccttttcaccactcggaagcttcctgccatgatacattgagacctcaatgttaatgccaattggggtttggggttctcataaactcagaagtccaggaaaatcgcctgctgcctcccacaacactctgagggcattctggaatcctaccacttacctggagcctgctggcctcaactgttttgaagtctgtgtctgggccatgcaggtaaatgggaggatgttctgtggccataaaaatacccgaagtcccacctaaagttgatgcagggtcttctgcatttcattgcaaaattgttctatcatttctatagttttcagcctacagtcaggggccaggactttgcacccttggtaaacctcaatctcttctccttcctggcttctactcctttctccctcaatcccaaatcaaggcccttgattgtctggaggtaggaaagcctggttctggctcatgatatagtctacatcatagcctttgtcatctcatggattcactcaacaaccgtgtgtggatggggccacccaatatgtgccaggagttgaggacacgcagggttatgatgatgaaatagataaggggcccacactcacggaccctgcaggacagtggagctgtggacccagcatgcgagtaaagacccagtgagctcaccagacagatcatttaaatcaggtg

SEQ ID NO: 6 - DNA, 1173 bp, Artificial Sequence
  sequence of STAR6
tgacccaccacagacatcccctctggcctcctgagtggtttcttcagcacagcttccagagccaaattaaacgttcactctatgtctatagacaaaaagggttttgactaaactctgtgttttagagagggagttaaatgctgttaactttttaggggtgggcgagagggatgacaaataacaacttgtctgaatgttttacatttctccccactgcctcaagaaggttcacaacgaggtcatccatgataaggagtaagacctcccagccggactgtccctcggcccccagaggacactccacagagatatgctaactggacttggagactggctcacactccagagaaaagcatggagcacgagcgcacagagcagggccaaggtcccagggacagaatgtctaggagggagattggggtgagggtaatctgatgcaattactgtggcagctcaacattcaagggagggggaagaaagaaacagtccctgtcaagtaagttgtgcagcagagatggtaagctccaaaatttgaaactttggctgctggaaagttttagggggcagagataagaagacataagagactttgagggtttactacacactagacgctctatgcatttatttatttattatctcttatttattactttgtataactcttataataatcttatgaaaacggaaaccctcatatacccattttacagatgagaaaagtgacaattttgagagcatagctaagaatagctagtaagtaaaggagctgggacctaaaccaaaccctatctcaccagagtacacactctttttttttttccagtgtaattttttttaatttttattttactttaagttctgggatacatgtgcagaaggtatggtttgttacataggtatatgtgtgccatagtggattgctgcacctatcaacccgtcatctaggtttaagccccacatgcattagctatttgtcctgatgctctccctcccctccccacaccagacaggccttggtgtgtgatgttcccctccctgtgtccatgtgttctcactgttcagctcccacttatgagtgagaacgtgtggtatttggttttctgttcctgtgttagtttgctgaggatgatggcttccagcttcatccatgtccctgcaaaggacacgatc

SEQ ID NO: 7 - DNA, 2101 bp, Artificial Sequence
  sequence of STAR7
atcatgccagcttaggcgacagagtgagactggacataataacaataataataaaaataaataaataaaacaattatctgagaggaaaaatttgattcataataaagagaataaaggtttttggcgtgtttgttttgttttcacctaagaacagctgttcccctcattgggttagttttatttgcaagcagaaatcatctccgcatgatttccagggtgatggaaaactgaatatgaatccaccttctgccatctattcacttgtcacatttaataagacactcatgcctattttagcatgttttcttccctaccaaatgagttagtaacatcaagagattaaaataacacaaataagaacattgaaggtattcaaatgttacatacaaatattaaacacaatattattataattattcctggaaatgacattgcctctactctcaaggtaaaggtcatttttcttgatttaaacttttttctcaagtttgaaatctctaagtttcaacccgtaatctatttgcaagtttgtgcaaattttagggattgaatccatagtaattagtgatttattgtggtgtagggagacaagtcaaaagaatcaggactgctaggtagatgactaaggaaaggatggttcacgaggtgacataaagcactcagaagaaaaaggtcaggaaacggaggacagaaaaaaacctaagttctgctgggtgatgctgaatttgtcatcacaaaatctgcattgtggaagctttagctattgaggagattgctcaagtgtagaactgagaacaataggcagtgaacccgagagaacatcaagagactgagagaaaatgaaccagacttccaggtgctccatgttccaaccaacattttgtattgtcagaaggaattgagaggcaaaaggaaacccaataaaaaataaaacaggaaagggcatacatgattaccaccccttttctcaccagctgctcatggaccagctttctcctagtgctattttcttggtcactgcatcactctgctaacatagtttccccactagctctgaggctgtcccagaggggaagccagctgtcatctccttcttccacactctgttggaggaacctgtcattagcagctccctactaaacgcatttatgacaaacaggcaggagataattaactagaaagtgaacaaactcaaacttcagagcctctcatttgtatgaatgcccttgtaaggtcttgggcctattttaatatttataaatgtgttattttcttctaaagaaaaccaccaaattgtataagctacagaatctgcaaaactgaggtccatccatgcactcaggatacattcatagcatctctgagctggaaaatatcttaaaggtcatatatgtcctccaacactgcaagaatctctctggcagcattcttttaaaatcatcatctaaaagagggaaatccccagctgtgtttggattttgctctgtcacttgtccagtttccccatccataaaagggcaacaatatgaatttcctgataaggtagttgttaatataaatacaaagtgcgtagccacttccctaagaaaaatatggggtttctgcttcacagtctagggagaggaaaaaaaaggggggtcagaagtgattattattatcattctatattggaatgttttcagacataaaaagctcaccacgtcttaggccagacagatgcattatgaaagttaagctaagtcttcctcatcatgagctgcacctatatccccattacttcttctagaactgcataatttatttattctttcttcaaaagtttgagagagccattcttgtcctctaagatttttttttttttttttggagacagagtctccgtctgttgcccaggctggagtgcaatggcactatctcagctcactgcaacctctgcctcccagattcaagtgattctcctgcctcagcctcccgagtagctgggattacaagcacgcaccaccacaaccagctaatttttcgtattttttagtagagacgaggttttaccatgttggccaggctggtcttgaactcctgacctcgggtgatccacccacct

SEQ ID NO: 8 - DNA, 1821 bp, Artificial Sequence
  sequence of STAR8
gagatcacctcgaagagagtctaacgtccgtaggaacgctctcgggttcacaaggattgaccgaaccccaggatacgtcgctctccatctgaggcttgctccaaatggccctccactattccaggcacgtgggtgtctcccctaactctccctgctctcctgagcccatgctgcctatcacccatcggtgcaggtcctttctgaagagctcgggtggattctctccatcccacttcctttcccaagaaagaagccaccgttccaagacacccaatgggacattccccttccacctccttctccaaagttgcccaggtgttcatcacaggttagggagagaagcccccaggtttcagttacaaggcataggacgctggcatgaacacacacacacacacacacacacacacacacacacacacacgactcgaagaggtagccacaagggtcattaaacacttgacgactgttttccaaaaacgtggatgcagttcatccacgccaaagccaagggtgcaaagcaaacacggaatggtggagagattccagaggctcaccaaaccctctcaggaatattttcctgaccctgggggcagaggttggaaacattgaggacatttcttgggacacacggagaagctgaccgaccaggcattttcctttccactgcaaatgacctatggcgggggcatttcactttcccctgcaaatcacctatggcgaggtacctccccaagcccccacccccacttccgcgaatcggcatggctcggcctctatccgggtgtcactccaggtaggcttctcaacgctctcggctcaaagaaggacaatcacaggtccaagcccaaagcccacacctcttccttttgttatacccacagaagttagagaaaacgccacactttgagacaaattaagagtcctttatttaagccggcggccaaagagatggctaacgctcaaaattctctgggccccgaggaaggggcttgactaacttctataccttggtttaggaaggggaggggaactcaaatgcggtaattctacagaagtaaaaacatgcaggaatcaaaagaagcaaatggttatagagagataaacagttttaaaaggcaaatggttacaaaaggcaacggtaccaggtgcggggctctaaatccttcatgacacttagatataggtgctatgctggacacgaactcaaggctttatgttgttatctcttcgagaaaaatcctgggaacttcatgcactgtttgtgccagtatcttatcagttgattgggctcccttgaaatgctgagtatctgcttacacaggtcaactccttgcggaagggggttgggtaaggagcccttcgtgtctcgtaaattaaggggtcgattggagtttgtccagcattcccagctacagagagccttatttacatgagaagcaaggctaggtgattaaagagaccaacagggaagattcaaagtagcgacttagagtaaaaacaaggttaggcatttcactttcccagagaacgcgcaaacattcaatgggagagaggtcccgagtcgtcaaagtcccagatgtggcgagcccccgggaggaaaaaccgtgtcttccttaggatgcccggaacaagagctaggcttccggagctaggcagccatctatgtccgtgagccggcgggagggagaccgccgggaggcgaagtggggcggggccatccttctttctgctctgctgctgccggggagctcctggctggcgtccaagcggcaggaggccgccgtcctgcagggcgccgtagagtttgcggtgcagagt

SEQ ID NO: 9 - DNA, 1929 bp, Artificial Sequence
  sequence of STAR9
atgagcccccaaaaatgatcctctggcttatgacaacctgatgcagcccaggaaatgcctgcaacatgcccactagcagctgggaacccctctgtgaggaagagaacgttttacattaagaaaccctttgttttgcagcagagactattcaggtcacacatgtgtggcctctcagttctttgagccatttgaagttctctatccttgctgggaggctgagctctccatggaaacctggtccgatagtgagaggagcagaccctctggaaacacctttttacacctgaccaaagcagccagtcatgggccagtgatgcaacaaggtcaaccggtgcattctggcccctcagaaaagcagcccccgggaaggtcaggaggaggctgctgactccctcttcccctgcagccgccccaagcacacccaggagccctgcaggtttgggttcaccaggtgccagcaggtcccacgatgctgcatttcttacgagctcctggaggatgcagatggtcctggtcagaggctgcattctgagtatcaggagccatggggcaacgtttctgcgattgaggaaggggcatttctggggtgggcagaacaaaggtctttggctgagctggagcatccgcctccatcagtgttttccggcaactgtactatccatcgtcttcccttcccacagctgaccatggctttggaaaatgctctgaaactttcttttcagaagagttgactcccaactccacacttaggggaagtcaagcctacttctcagaattcagagaaggcataaaaaagaattcatttctaaaggccctttagaagtaacttcaggtctgacagcggccagctaatttctggtcgccttccaggaatcttctgactgcaaaaaaaaagcatttaccacctgaacacaaacccagttacagatagaaaaacatagtcatttaaatagaatataagcatctggcctctgcccatcataatggagtaacacaaaaatctattttcaaaaggaaactaaatattattgaccaaaacatgaatggggagacctcagggtgatacagctcttgcctggatggaatttgtaatcaagaggatgagacaggattgtaacttgtgccaatgtgaaagggtttgctcaggtatcattcattttgcttaaatgcatgggtaatttccaaagttctttggagctgaatttcacaatttagtgcaggtcctggtgagcccaccttgacttatctcacagtacaatgcagtggcgtggctacaatgctgggcaagagaagccaatgtcaacagcccaggagtggctgggtccttaccaggctcccaggcatgcttcatggtgggccctgggctgggaggaacagcacctttgcctggtccatgagtatctgggtcaaactctcctgtggacacagaaggccatggcgacaggcattcccaggaaaagaaaagggcagcagctgaaatcgtcaggtggagaaggcagtcatccttgctcagtcaactctaatccggctgcctcctcctcagcttcagggtgaacctctcctaagctgtgtctttggtatctgatgggcattaggtgctggtgaaaaagctggagggtcctttgggatattacagaagcccaatctagccttgtattcaatatctaggcactctcacccctgaagttctacgtttccagatttctgaaaacatgggaaagcatgtgtgtgatgtctgaggtccccctcagcctctggtgtagggttaggagggctctaaagggtggcagctccagtgtcccagtggggcctgaagttggtcccttcccttcccagctcccatccatggtttagcccaatcccttccgtacctaagagtactgcacatggatgctccacgcagagcctctgctccactcccaggaagtg

SEQ ID NO: 10 - DNA, 1167 bp, Artificial Sequence
  sequence of STAR10
  misc_feature (452)..(1143): "N" stands for any nucleotide on various positions
aggtcaggagttcaagaccagcctggccaacatggtgaaaccctgtccctacaaaaaatacaaaaattagccgggcgtggtggggggcgcctataatcccagctactcaggatgctgagacaggagaattgtttgaacccgggaggtggaggttgcagtgaactgagatcgcgccactgcactccagcctggtgacagagagagactccgtctcaacaacagacaaacaaacaaacaaacaacaacaaaaatgtttactgacagctttattgagataaaattcacatgccataaaggtcaccttctacagtatacaattcagtggatttagtatgttcacaaagttgtacgttgttcaccatctactccagaacatttacatcacccctaaaagaagctctttagcagtcacttctcattctccccagcccctgccaaccacgaatctactntctgtctctattctgaatatttcatataaaggagtcctatcatatgggccttttacgtctaccttctttcacttagcatcatgtttttaagattcatccacagtgtagcacgtgtcagttaattcatttcatcttatggctggataatgctctattgtatgcatatccctcactttgcttatccattcatcaactgattgacatttgggttatttctactttttgactattatgagtaatgctgctatgaacattcctgtaccaatcgttacgtggacatatgctttcaattctcctgagtatgtaactagggttggagttgctgggtcatatgttaactcagtgtttcatttttttgaagaactaccaaatggttttccaaagtggatgcaacactttacattcccaccagcaagatatgaaggttccaatgtctctacatttttgccaacacttgtgattttcttttatttatttatttatttatttatttttgagatggagtctcactctgtcacccaggctggagtgcagtggcacaatttcagctcactgcaatctccacctctcgggctcaagcgatactcctgcctcaacctcccgagtaactgggattacaggcgcccaccaccacaccaagctaattttttgtatttttagtagagacggggtttcatcatgtcggccaggntgtactcgaactctgacctcaagt

SEQ ID NO: 11 - DNA, 1377 bp, Artificial Sequence
  sequence of STAR11
gattctgggtgggtttgatgatctgagagtcccttgaataaaaagaattctagaaaagctgtgaaacttcacctttcccctattcttaaccttacttgcctttgggaggctgaggcaggaggatgacttaaggccaggagtttgagaatgtagtgagctatgaccacaccggttacactcaagcctgggcgagaccacaacaaaaaccttacctgccaactgctccatgctggaaatttatttcgtttcttggattgtggaaagaactggcttactgaaaaccacacttctctaaaacccttcttccagttaggtgttaagattttaacagcctttcctatctgaataaaaactgcacacaaagtaaacttaagagatgtcaacaactcatctgtttgttacaagatgagtctccatgcttcatcgcctgtggggaatcctcatcagcgtctagtggcaaagactcctgtgtgctcaccgaaacgctccccttcctccagggcacacagtcacatggatttcccatgcaccctggcagctcagcaggagtccatgacttaagaaggccaatggactgtgggtgaagtctgtggacggggaagccacatgcgtcacttccaggcctgggcgtgtgcatcctccactctcttcccctgtgggtgcagaaggcggggcagagggccctgaaaccttggaggtcggtggagcccaaaatgaaggagcgtgggcctctgggtcttcatgtaaatttaggtaacactgaactgtcaggtgaacaagaaataaacgtcaaatgtattcagtcgattagatttggtgatggttgttacagcggttaccctccctcaacataataaattttcaaacaactcataatggctcactcatgtataaaatattccatatgaaatcccgggataacatgcttattctagctcaagcttaatcagagtagtccatctgagggaggagatagtagagggcagcaaggggttgtcactgaagataactagccttgctaaaagaatggttgaagaagtgagctacagatagggtaaatccacatctcagacattctgtgatggtcctgatattatcctaaagtaaaatgtagagttgaaccattttaattagattctagaattctattaatttataagatgggcatttccacaaaggactaaacaaagtacaagaggattaaataatcatccacatgggaggcaccgccttgcactttaaaatgatggagcttatcaagactggctgtggatatctgtccctgggagggttttttcccccatttttttcctttttgagacatgttctcgctatgttgcccaggctggtcttgaactcctgggctcaagtgatcct

SEQ ID NO: 12 - DNA, 1051 bp, Artificial Sequence
  sequence of STAR12
atcctgcttctgggaagagagtggcctcccttgtgcaggtgactttggcaggaccagcagaaacccaggtttcctgtcaggaggaagtgctcagcttatctctgtgaagggtcgtgataaggcacgaggaggcaggggcttgccaggatgttgcctttctgtgccatatgggacatctcagcttacgttgttaagaaatatttggcaagaagatgcacacagaatttctgtaacgaataggatggagttttaagggttactacgaaaaaaagaaaactactggagaagagggaagccaaacaccaccaagtttgaaatcgattttattggacgaatgtctcactttaaatttaaatggagtccaacttccttttctcacccagacgtcgagaaggtggcattcaaaatgtttacacttgtttcatctgcctttttgctaagtcctggtcccctacctcctttccctcacttcacatttgtcgtttcatcgcacacatatgctcatctttatatttacatatatataatttttatatatggcttgtgaaatatgccagacgagggatgaaatagtcctgaaaacagctggaaaattatgcaacagtggggagattgggcacatgtacattctgtactgcaaagttgcacaacagaccaagtttgttataagtgaggctgggtggtttttattttttctctaggacaacagcttgcctggtggagtaggcctcctgcagaaggcattttcttaggagcctcaacttccccaagaagaggagagggcgagactggagttgtgctggcagcacagagacaagggggcacggcaggactgcagcctgcagaggggctggagaagcggaggctggcacccagtggccagcgaggcccaggtccaagtccagcgaggtcgaggtctagagtacagcaaggccaaggtccaaggtcagtgagtctaaggtccatggtcagtgaggctgagacccagggtccaatgaggccaaggtccagagtccagtaaggccgagatccagggtccagggaggtcaag

SEQ ID NO: 13 - DNA, 1291 bp, Artificial Sequence
  sequence of STAR13
ctgccctgatcccttaatgcttttggcccagagcaccccgctaagtccaaccccagaggggcctcatccgcaaagcctcgggaagaggacagtgacggaggcggctgccctgtgagctgcacggggcagaatgtccttttggcgtcatgttggatgtccacacatccatatggggtcagttctattaggattccttcgggaagaggtagagggtaggaggggttaagccacgagacgaggcatgcagaggggtggcctggatgggtctgcactgctgtccatgcacacggggagcgttgcaaattgtgcttcccagcccatagtgcccccacagaggagcccgggagtccctggtgggcgtctgtgttcctgcaaggagccagtggagatggccccgtgaactctcatcccccttgccttggtggggtctctggcaggtttatggagccgtacatctttgggagccgcctggaccacgacatcatcgacctggaacagacagccacgcacctccagctggccttgaacttcaccgcccacatggcctaccgcaagggcatcatcttgtttataagccgcaaccggcagttctcgtacctgattgagaacatggcccgtgactgtggcgagtacgcccacactcgctacttcaggggcggcatgctgaccaacgcgcgcctcctctttggccccacggtccgcctgccggacctcatcatcttcctgcacacgctcaacaacatctttgagccacacgtggccgtgagagacgcagccaagatgaacatccccacagtgggcatcgtggacaccaactgcaacccctgcctcatcacctaccctgtacccggcaatgacgactctccgctggctgtgcacctctactgcaggctcttccagacggccatcacccgggccaaggagaagcggcagcaggttgaggctctctatcgcctgcagggccagaaggagcccggggaccaggggccagcccaccctcctggggctgacatgagccattccctgtgatgttcactctcctcccaaagcaaaccacagccaagcctgtctgagctgggagtccccttccccagccctgggtcagcggcatcctcagtcgttgttacttactcagctgatgtcacagtgcagacatccaccgttccaccacagaaccagtggctgagcggaccaacgttgccatgtgcgtttgctctgtggggaacagagcacagagggtgagcgacatgtgcagaacggccccttggctgcagttaggacctcagtggct

SEQ ID NO: 14 - DNA, 711 bp, Artificial Sequence
  sequence of STAR14
agcaaggaccagggctctgcctccccagtcagcatgagcagagcagactcctttgagcagagcatcagggcagaaatagaacagtttctgaatgagaaaagacagcatgagacccaaaaatgtgatgggtcagtggagaagaaaccagacacacatgaaaattcggcgaagtcactctcgaaatcccaccaagagccggctacaaaggtggtgcaccggcagggcctgatgggcgtccagaaggagttcgccttctgcagacctcccccggttagcaaagacaaacgtgcagcccagaagcctcaggtccaaggtcacgaccacgaccacgcaggagaaggagggcagcacaaagccagcaacccccaccgcccttcagaagcagtacagaataaaagtgggattaaaaggaacgccagcaccgcaaggaggggaaagcgagtcacgagcgccgtacaggcgcccgaggcgtccgactccagcagcgacgacggcattgaggaggccatccagctgtaccaggtgcagaaaacacacaaggaggccgacggggacccgccccagagggtccagctccaagaggaaagagcacctgcccctcccgcacacagcacaagcagcgccacaaaaagtgccttgccagagacccacaggaaaacacccagcaagaagaagccagtgcccaccaagaccacggaccctggtccaggg

SEQ ID NO: 15 - DNA, 1876 bp, Artificial Sequence
  sequence of STAR15
cagtacatgcagaactgagtccaaacgagacggacagcaaacccggcagtgggctcccagacattcctgggggaaagggatcctaaccacaggcagttaaagtcatctcctccaaccctctatgacacaggctgtgcgctgtcatttaaaagctgagtgaaatttaacccttttcccatttagaaaaacaaagcgcagctggctgccagcactcatttaattttacataaacgtgctctttgaggctgaagcaaatctgactgattttcaatgtgaaaataaaatgtaaaaactgttcttggaattatttctaaacagaacatcagaatcgtctgaatcatcagaatcggctattttggaaaaatcggattcatcaaacgaatcttcggccaacaactgttagagaacgatgttaacaccacgcataggaatgttacattttctagaatttgacattttcattgacggaaaattactgtatcttgtatatggaaataccactactaaaaacataatgctataaatagaatgatgtcttttgtttccaaagtcaatatactcgagcaatgcaaaaataataataaaagtgagatacttcatggcaaagctgccgcaggataaacattgcagccacaagtgcccccagtattctcggggcaaactggaaaagggctaacaggcaacattttcatgttattctactgagtgcagtaattatttttaaaaatatacatgaataatgaaaaaactgtggtatggttttaaagaaatttccataacctggtgaaactcttcacacagggtaataggttcataaagccttggtcctctgcaaaacaagcatcaacttgacaatgactaaaagaagcaacagcaaaactgtcacgcatttggagccatggcctgggttgggccggtgtaaagctctccgccctctggagcaagtctgggccccagcggctggcatgtgggcactgcagggcctgggttgggcaggtgtgcagctctccgtcatctgagcctagtctgaggcctggtggctggcacgtgggccctgcagggcctctacttctcaccccagctccacttccctccctgccctcactgggtctcacagagccaatgaacactggggtcagattcagggcccagcatccactgcagtgggcactgcccttccacaaggcctggctccaggaagcaacccccacctcagccacacagtagggcaacaggaaatcccattcccccatgccagtgactacaccagggaaggggctcacgtgaggctggccccaggcctgctgtgagaccgcgttgtctatgagcttggatttaaggaacttgggagcaagaagctttctttcattacgggccaccagcagggaaaaaagttagcccaacgcagttgacagtcacacccccaccaggaccccagggcacagaaggagggaagaggacaacagaggatgaggtggggccagcagagggacagagaagagctgcctgccctggaacaggcagaaagcatcccacgtgcaagaaaaagtaggccagctagacttaaaatcagaactaccgctcatcaaaagatagtgtaacatttggggtgctataattttaacatgtcccccaaaaggcatgtgttggaaatttaatccccaacaaaccagggctgggaggtggagcctcatgagaggtggtgaggccatgagggtggagtgaatggatgaatgccattgtctcgggaatgggcctcttctacaaggacgagttcagcccccctttctcttgctcaccctctctttgccctttcgctagggagtgacgtaacaagaaggccctcacaagatgctggcaccttgatcttggactc

SEQ ID NO: 16 - DNA, 1282 bp, Artificial Sequence
  sequence of STAR16
cgcccacctcggctttccaaagtgctgggattacaggcatgagtcactgcgcccatcctgattccaagtctttagataataacttaactttttcgaccaattgccaatcaggcaatctttgaatctgcctatgacctaggacatccctctccctacaagttgccccgcgtttccagaccaaaccaatgtacatcttacatgtattgattgaagttttacatctccctaaaacatataaaaccaagctatagtctgaccacctcaggcacgtgttctcaggacctccctggggctatggcatgggtcctggtcctcagatttggctcagaataaatctcttcaaatattttccagaattttactcttttcatcaccattacctatcacccataagtcagagttttccacaaccccttcctcagattcagtaatttgctagaatggccaccaaactcaggaaagtattttacttacaattaccaatttattatgaagaactcaaatcaggaatagccaaatggaagaggcatagggaaaggtatggaggaaggggcacaaagcttccatgccctgtgtgcacaccaccctctcagcatcttcatgtgttcaccaactcagaagctcttcaaactttgtcatttaggggtttttatggcagttccactatgtaggcatggttgataaatcactggtcatcggtgatagaactctgtctccagctcctctctctctcctccccagaagtcctgaggtggggctgaaagtttcacaaggttagttgctctgacaaccagcccctatcctgaagctattgaggggtcccccaaaagttaccttagtatggttggaagaggcttattatgaataacaaaagatgctcctatttttaccactagggagcatatccaagtcttgcgggaacaaagcatgttactggtagcaaattcatacaggtagatagcaatctcaattcttgccttctcagaagaaagaatttgaccaagggggcataaggcagagtgagggaccaagataagttttagagcaggagtgaaagtttattaaaaagttttaggcaggaatgaaagaaagtaaagtacatttggaagagggccaagtgggcgacatgagagagtcaaacaccatgccctgtttgatgtttggcttggggtcttatatgatgacatgcttctgagggttgcatccttctcccctgattcttcccttggggtgggctgtccgcatgcacaatggcctgccagcagtagggaggggccgcatg

SEQ ID NO: 17 - DNA, 793 bp, Artificial Sequence
  sequence of STAR17
atccgaggggaggaggagaagaggaaggcgagcagggcgccggagcccgaggtgtctgcgagaactgttttaaatggttggcttgaaaatgtcactagtgctaagtggcttttcggattgtcttatttattactttgtcaggtttccttaaggagagggtgtgttgggggtgggggaggaggtggactggggaaacctctgcgtttctcctcctcggctgcacagggtgagtaggaaacgcctcgctgccacttaacaatccctctattagtaaatctacgcggagactctatgggaagccgagaaccagtgtcttcttccagggcagaagtcacctgttgggaacggcccccgggtccccctgctgggctttccggctcttctaggcggcctgatttctcctcagccctccacccagcgtccctcagggacttttcacacctccccacccccatttccactacagtctcccagggcacagcacttcattgacagccacacgagccttctcgttctcttctcctctgttccttctctttctcttctcctctgttccttctctttctctgtcataatttccttggtgctttcgccaccttaaacaaaaaagagaaaaaaataaaataaaaaaaacccattctgagccaaagtattttaagatgaatccaagaaagcgacccacatagccctccccacccacggagtgcgccaagacgcacccaggctccatcacagggccgagagcagcgccactctggtcgtacttttgggtcaagagatcttgcaaaagagg

SEQ ID NO: 18 - DNA, 492 bp, Artificial Sequence
  sequence of STAR18
atctttttgctctctaaatgtattgatgggttgtgttttttttcccacctgctaataaatattacattgcaacattcttccctcaacttcaaaactgctgaactgaaacaatatgcataaaagaaaatcctttgcagaagaaaaaaagctattttctcccactgattttgaatggcacttgcggatgcagttcgcaaatcctattgcctattccctcatgaacattgtgaaatgaaacctttggacagtctgccgcattgcgcatgagactgcctgcgcaaggcaagggtatggttcccaaagcacccagtggtaaatcctaacttattattcccttaaaattccaatgtaacaacgtgggccataaaagagtttctgaacaaaacatgtcatctttgtggaaaggtgtttttcgtaattaatgatggaatcatgctcatttcaaaatggaggtccacgatttgtggccagctgatgcctgcaaattatcct

SEQ ID NO: 19 - DNA, 1840 bp, Artificial Sequence
  sequence of STAR19
tcacttcctgatattttacattcaaggctagctttatgcatatgcaacctgtgcagttgcacagggctttgtgttcagaaagactagctcttggtttaatactctgttgttgccatcttgagattcattataatataatttttgaatttgtgttttgaacgtgatgtccaatgggacaatggaacattcacataacagaggagacaggtcaggtggcagcctcaattccttgccacccttttcacatacagcattggcaatgccccatgagcacaaaatttgggggaaccatgatgctaagactcaaagcacatataaacatgttacctctgtgactaaaagaagtggaggtgctgacagcccccagaggccacagtttatgttcaaaccaaaacttgcttagggtgcagaaagaaggcaatggcagggtctaagaaacagcccatcatatccttgtttattcatgttacgtccctgcatgaactaatcacttacactgaaaatattgacagaggaggaaatggaaagatagggcaacccatagttctttttccttttagtctttccttatcagtaaaccaaagatagtattggtaaaatgtgtgtgagttaattaatgagttagttttaggcagtgtttccactgttggggtaagaacaaaatatataggcttgtattgagctattaaatgtaaattgtggaatgtcagtgattccaagtatgaattaaatatccttgtatttgcatttaaaattggcactgaacaacaaagattaacagtaaaattaataatgtaaaagtttaatttttacttagaatgacattaaatagcaaataaaagcaccatgataaatcaagagagagactgtggaaagaaggaaaacgtttttattttagtatatttaatgggactttcttcctgatgttttgttttgttttgagagagagggatgtgggggcagggaggtctcattttgttgcccaggctggacttgaactcctgggctccagctatcctgccttagcttcttgagtagctgggactacaggcacacaccacagtgtctgacattttctggattttttttttttttttattttttttgtgagacaggttctggctctgttactcaggttgcagtgcagtggcatgatagcggctcactgcagcctcaacctcctcagcttaagctactctcccacttcagcctcctgagtagccaggactacagttgtgtgccaccacacctgtggctaatttttgtagagatggggtctctccacgttgccgaggctggtctccaactcctggtctcaagcgaacctcctgacttggcctcccgaagtgctgggattacaggcttgagccactgcatccagcctgtcctctgtgttaaacctactccaatttgtctttcatctctacataaacggctcttttcaaagttcccatagacctcactgttgctaatctaataataaattatctgccttttcttacatggttcatcagtagcagcattagattgggctgctcaattcttcttggtatattttcttcatttggcttctggggcatcacactctctttgagttactcattcctcattgatagcttcttcctagtcttctttactggttcttcctcttctccctgactccttaatattgtttttctccccaggctttagttcttagtcctcttctgttatctatttacacccaattctttcagagtctcatccagagtcatgaacttaaacctgtttctgtgcagataattcacattattatatctccagcccagactctcccgcaaactgcagactgatcctactg

SEQ ID NO: 20 - DNA, 780 bp, Artificial Sequence
  sequence of STAR20
gatctcaagtttcaatatcatgttttggcaaaacattcgatgctcccacatccttacctaaagctaccagaaaggctttgggaactgtcaacagagctacagaaaagtcagtaaagaccaatggacccctcaaacaaaaacagccaagcttttctgccaaaaagatgactgagaagactgttaaagcaaaaaactctgttcctgcctcagatgatggctatccagaaatagaaaaattatttcccttcaatcctctaggcttcgagagttttgacctgcctgaagagcaccagattgcacatctccccttgagtgaagtgcctctcatgatacttgatgaggagagagagcttgaaaagctgtttcagctgggccccccttcacctttgaagatgccctctccaccatggaaatccaatctgttgcagtctcctttaagcattctgttgaccctggatgttgaattgccacctgtttgctctgacatagatatttaaatttcttagtgctttagagtttgtgtatatttctattaataaagcattatttgtttaacagaaaaaaagatatatacttaaatcctaaaataaaataaccattaaaaggaaaaacaggagttataactaataagggaacaaaggacataaaatgggataataatgcttaatccaaaataaagcagaaaatgaagaaaaatgaaatgaagaacagataaatagaaaacaaatagcaatatgaaagacaaacttgaccgggtgtggtggctgatgcctgtaatcc

SEQ ID NO: 21 - DNA, 607 bp, Artificial Sequence
  sequence of STAR21
gatcaataatttgtaatagtcagtgaatacaaaggggtatatactaaatgctacagaaattccattcctgggtataaatcctagacatatttatgcatatgtacaccaagatatatctgcaagaatgttcacagcaaatctctttgtagtagcaaaaggccaaaaggtctatcaacaagaaaattaatacattgtggcacataatggcatccttatgccaataaaaatggatgaaattatagttaggttcaaaaggcaagcctccagataatttatatcatataattccatgtacaacattcaacaacaagcaaaactaaacatatacaaatgtcagggaaaatgatgaacaaggttagaaaatgattaatataaaaatactgcacagtgataacatttaatgagaaaaaaagaaggaagggcttagggagggacctacagggaactccaaagttcatggtaagtactaaatacataatcaaagcactcaaaatagaaaatattttagtaatgttttagctagttaatatcttacttaaaacaaggtctaggccaggcacggtggctcacacctgtaatcccagcactttgggaggctgaggcgggt

SEQ ID NO: 22 - DNA, 1380 bp, Artificial Sequence
  sequence of STAR22
cccttgtgatccacccgccttggcctcccaaagtgctgggattacaggcgtgagtcactacgcccggccaccctccctgtatattatttctaagtatactattatgttaaaaaaagtttaaaaatattgatttaatgaattcccagaaactaggattttacatgtcacgttttcttattataaaaataaaaatcaacaataaatatatggtaaaagtaaaaagaaaaacaaaaacaaaaagtgaaaaaaataaacaacactcctgtcaaaaaacaacagttgtgataaaacttaagtgcctgaaaatttagaaacatccttctaaagaagttctgaataaaataaggaataaaataatcacatagttttggtcattggttctgtttatgtgatggattatgtttattgatttgtgtatgttgaacttatctcaatagatgcagacaaggccttgataaaagtttttaacaccttttcatgttgaaaactctcaatagactaggtattgatgaaacatatctcaaaataatagaagctatttatgataaacccatagccaatatcatactgagtgggcaaaagctggaagcattccctttgaaaactggcacaagacaaggatgccctctctcaccactcctattaaatgtagtattggaagttctggccagagcaatcaggcaggagaaagaaaaggtattaaaataggaagagaggaagtcaaattgtctctgtttgcagtaaacatgattgtatatttagaaaaccccattgtctcatcctaaaaactccttaagctgataaacaacttcagcaaagtctcaggatacaaaatcaatgtgcaaaaatcacaagcattcctatacaccgataatagacagcagagagccaaatcatgagtgaagtcccattcacaattgcttcaaagaaaataaaatacttaggaatacaactttcacgggacatgaaggacattttcaaggacaactaaaaaccactgctcaaggaaatgagagaggacacaaagaaatggaaaaacattccatgctcatggaagaatcaatatcatgaaaatggccatactgcccaaagtaatttatagattcaatgctaaccccatcaagccaccattgactttcttcacagaactagaaaaaaactattttaaaactcatatgtagtcaaaaagagtcggtatagccaagacaatcctaagcataaagaacaaagctggatgcatcacgctgacttcaaaccatactacaaggctacagtaaccaaaacagcatggtactggtaccaaaacagatagatagaccgatagaacagaacagaggcctcggaaataacaccacacatctacaaccctttgatcttcaa

SEQ ID NO: 23 - DNA, 1246 bp, Artificial Sequence
  sequence of STAR23
atcccctcatccttcagggcagctgagcagggcctcgagcagctgggggagcctcacttaatgctcctgggagggcagccagggagcatggggtctgcaggcatggtccagggtcctgcaggcggcacgcaccatgtgcagccgcccccacctgttgctctgcctccgccacctggccatgggcttcagcagccagccacaaagtctgcagctgctgtacatggacaagaagcccacaagcagctagaggaccttgtgttccacgtgcccagggagcatggcccacagcccaaagaccagtcaggagcaggcaggggcttctggcaggcccagctctacctctgtcttcacacagatgggagatttctgttgtgattttgagtgatgtgcccctttggtgacatccaagatagttgctgaagcaccgctctaacaatgtgtgtgtattctgaaaacgagaacttctttattctgaaataattgatgcaaaataaattagtttggatttgaaattctattcatgtaggcatgcacacaaaagtccaacattgcatatgacacaaagaaaagaaaaagcttgcattccttaaatacaaatatctgttaactatatttgcaaatatatttgaatacacttctattatgttacatataatattatatgtatatgtatatataatatacatatatatgttacatataatatacttctattatgttacatataatatttatctataagtaaatacataaatataaagatttgagtagctgtagaacattgtcttatgtgttatcagctactactacaaaaatatctcttccacttatgccagtttgccatataaatatgatcttctcattgatggcccagggcaagagtgcagtgggtacttattctctgtgaggagggaggagaaaagggaacaaggagaaagtcacaaagggaaaactctggtgttgccaaaatgtcaagtttcacatattccgagacggaaaatgacatgtcccacagaaggaccctgcccagctaatgtgtcacagatatctcaggaagcttaaatgatttttttaaaagaaaagagatggcattgtcacttgtttcttgtagctgaggctgtgggatgatgcagatttctggaaggcaaagagctcctgctttttccacaccgagggactttcaggaatgaggccagggtgctgagcactacaccaggaaatccctggagagtgtttttcttactta

SEQ ID NO: 24 - DNA, 939 bp, Artificial Sequence
  sequence of STAR24
acgaggtcacgagttcgagaccagcctggccaagatggtgaagccctgtctctactaaaaatacaacaagtagccgggcgcggtgacgggcgcctgtaatcccagctactcaggaggctgaagcaggagaatctctagaacccaggaggcggaggtgcagtgagctgagactgccccgctgcactctagcctgggcaacacagcaagactctgtctcaaataaataaataaataaataaataaataaataaataaataaatagaaagggagagttggaagtagatgaaagagaagaaaagaaatcctagatttcctatctgaaggcaccatgaagatgaaggccacctcttctgggccaggtcctcccgttgcaggtgaaccgagttctggcctccattggagaccaaaggagatgactttggcctggctcctagtgaggaagccatgcctagtcctgttctgtttgggcttgatcctgtatcacttgattgtctctcctggactttccatggattccagggatgcaactgagaagtttatttttaatgcacttacttgaagtaagagttattttaaaacattttagcaaaggaaatgaattctgacaggttttgcactgaagacattcacatgtgaggaaaacaggaaaaccactatgctagaaaaagcaaatgctgttgagattgtctcacaaacacaaattgcgtgccagcaggtaggtttgagcctcaggttgggcacattttaccttaagcgcactgttggtggaacttaaggtgactgtaggacttatatatacatacatacatataatatatatacatatttatgtgtatatacacacacacacacacacacacacacagggtcttgctatcttgcccagggtggtctccaactctgggtctcaagcgatcctctgcctccccttcccaaag

SEQ ID NO: 25 - DNA, 1067 bp, Artificial Sequence
  sequence of STAR25
ataaaaaaataaaaaaccctgctctaatttgcaaaggctctatctttcctcccaaccacctgaaattttagtgaaaacggggcttcctgtaggaaggagtagctagctatcccggtccgctacaggttatcagtgcgtgaataccctgactcctaaggctcaggatttgactgggtcgcctcgtccgactgccccgcccccaacgcggacccacgtcaccgcgcgccagcctgcggccgtcctgacctcgcgggatttgagcttcggtgccaacaaacactcccaccgcggctgcgtccactttacctgccggcggcgaccagcttctgaagaaaagtgtccaccatggtgtcgaggagcttcaccctcgaaatggtagtgccgggtggcacagattccgaagacgacccctcatgccttttttcctcacagccgctgcctagattggcgctacttgcttcggccatgttgaagttgaacctccaaatctaactggcccggcctccccgcctgccggagctcccgattggccgctcccgcgaagggtgcctccgattggaagcagtagaacgtctgtcaccgagcagggcgggggcggggaagtcatcggaggctgagggcagcggggaggcgaggctctgcgcggtgggatgtccgcgaccggaaaaatacgcgcaagccaaagctcgggggctcaataaaaacttttaattacatttcagagacttcgtacagtgcaacagtgaatattcactgttaattttcacaagagtccatttcatcaaacgttcagagagtctgccttttcattcccttgttcctcagtgctccaatcaggtttccagtctcccagaggtttcttttagttttgattaccgaccaaaactccagtttagggagaatggaagtccaccgtcccatccccaccaaaacatatttcagtcaaacccaatcccagtccctaaagaattaggaaagtatgggccaagggtccttttaattatacacacatcacccttaaaactgcgtgtgtgtacgagaaataaagaaaaacacaagaggggctg

SEQ ID NO: 26 - DNA, 540 bp, Artificial Sequence
  sequence of STAR26
ccccctgacaagccccagtgtgtgatgttccccactctgtgtccatgcattctcattgttcaactcccatctgtgagtgagaacatgcagtgtttggttttctgtccttgagatagtttgctgagaatgatggtttccagcttcatccatgtccttgcaaaggaagtgaacttatccttttttatggcttcatagtattccatggcacatatgtgccacatttttttaatccagtctatcattgatggacatttgggttggttccaagtctttgctattgtgaatagcaccacaattaacatatgtgtgcatgtatacatctttatagtagcatgatttataatccttcgggtatataccctgtaatgggatcgctgggtcaaatggtatttctagttctagatccttgaggaatcaccacactgctttccacaatggttgaactaatttacgctcccaccagcagtgtaaaagcattcctatttctccacgtcctctccagtatctgttgtttcctgactttttaatgatcatcattct

SEQ ID NO: 27 - DNA, 1520 bp, Artificial Sequence
  sequence of STAR27
cttggccctcacaaagcctgtggccagggaacaattagcgagctgcttattttgctttgtatccccaatgctgggcataatgcctgccattatgagtaatgccggtagaagtatgtgttcaaggaccaaagttgataaataccaaagaatccagagaagggagagaacattgagtagaggatagtgacagaagagatgggaacttctgacaagagttgtgaagatgtactaggcagggggaacagcttaaggagagtcacacaggaccgagctcttgtcaagccggctgccatggaggctgggtggggccatggtagctttcccttccttctcaggttcagagtgtcagccttgaacttctaattcccagaggcatttattcaatgttttcttctaggggcatacctgccctgctgtggaagactttcttccctgtgggtcgccccagtccccagatgagacggtttgggtcagggccaggtgcaccgttgggtgtgtgcttatgtctgatgacagttagttactcagtcattagtcattgagggaggtgtggtaaagatggagatgctgggtcacatccctagagaggtgttccagtatgggcacatgggagggctggaaggataggttactgctagacgtagagaagccacatcctttaacaccctggcttttcccactgccaagatccagaaagtccttgtggtttcgctgctttctcctttttttttttttttttttttctgagatggagtctggctctgtcgcccaggctggagtgcagtggcacgatttcggctcactgcaagttccgcctcctaggttcataccattctcccacctcagcctcccgagtagctgggactacaggcgccaccacacccagctaattttttgtatttttagtagagacggcgtttcaccatgttagccaggatggtcttgatccgcctgcctcagcctcccaaagtgctgggattacaggcgtgagccaccgcgcccggcctgctttcttctttcatgaagcattcagctggtgaaaaagctcagccaggctggtctggaactcttgacctcaagtgatctgcctgcctcagcctcccaaagtgctgagattacaggcatgagccagtccgaatgtggctttttttgttttgttttgaaacaaggtctcactgttgcccaggctgcagtgcagtggcatacctcagctccactgcagcctcgacctcctgggctcaagcaatcctcccaactgagcctccccagtagctggggctacaagcgcatgccaccacgcctggctatttttttttttttttttttttttgagaaggagtttcattcttgttgcccaggctggagtgcaatggcacagtctcagctcactgcagcctccgcctcctgggttcaagcgattctcctgcctcagcctcccgagtagctgggattataggcacctgccaccatgcctggctaatttttttgtatttttagtagggatggggtttcaccatgtt

SEQ ID NO: 28 - DNA, 961 bp, Artificial Sequence
  sequence of STAR28
aggaggttattcctgagcaaatggccagcctagtgaactggataaatgcccatgtaagatctgtttaccctgagaagggcatttcctaactctccctataaaatgccaagtggagcaccccagatgaaatagctgatatgctttctatacaagccatctaggactggctttatcatgaccaggatattcacccactgaatatggctattacccaagttatggtaaatgctgtagttaagggggtcccttccacatggacaccccaggttataaccagaaagggttcccaatctagactccaagagagggttcttagacctcatgcaagaaagaacttggggcaagtacataaagtgaaagcaagtttattaagaaagtaaagaaacaaaaaaatggctactccataagcaaagttatttctcacttatatgattaataagagatggattattcatgagttttctgggaaaggggtgggcaattcctggaactgagggttcctcccacttttagaccatatagggtatcttcctgatattgccatggcatttgtaaactgtcatggcactgatgggagtgtcttttagcattctaatgcattataattagcatataatgagcagtgaggatgaccagaggtcacttctgttgccatattggtttcagtggggtttggttggcttttttttttttttaaccacaacctgttttttatttatttatttatttatttatttatttatattttttatttttttttagatggagtcttgctctgtcacccaggttagagtgcagtggcaccatctcggctcactgcaagctctgcctccttggttcacgccattctgctgcctcagcctcccgagtagctgggactacaggtgcctgccaccatacccggctaattttttctatttttcagtagagacggggtttcaccgtgttagccaggatggtc

SEQ ID NO: 29 - DNA, 2233 bp, Artificial Sequence
  sequence of STAR29
agcttggacacttgctgatgccactttggatgttgaagggccgccctctcccacaccgctggccacttttaaatatgtcccctctgcccagaagggccccagaggaggggctggtgagggtgacaggagttgactgctctcacagcagggggttccggagggaccttttctccccattgggcagcatagaaggacctagaagggccccctccaagcccagctgggcgtgcagggccagcgattcgatgccttcccctgactcaggtggcgctgtcctaaaggtgtgtgtgttttctgttcgccagggggtggcggatacagtggagcatcgtgcccgaagtgtctgagcccgtggtaagtccctggagggtgcacggtctcctccgactgtctccatcacgtcaggcctcacagcctgtaggcaccgctcggggaagcctctggatgaggccatgtggtcatccccctggagtcctggcctggcctgaagaggaggggaggaggaggccagcccctccctagccccaaggcctgcgaggctgcaagcccggccccacattctagtccaggcttggctgtgcaagaagcagattgcctggccctggccaggcttcccagctaggatgtggtatggcaggggtgggggacattgaggggctgctgtagcccccacaacctccccaggtagggtggtgaacagtaggctggacaagtggacctgttcccatctgagattcaagagcccacctctcggaggttgcagtgagccgagatccctccactgcactccagcctgggcaacagagcaagactctgtctcaaaaaaacagaacaacgacaacaaaaaacccacctctggcccactgcctaactttgtaaataaagttttattggcacatagacacacccattcatttacatactgctgcggctgcttttgcattacccttgagtagacgacagaccacgtggccatggaagccaaaaatatttactgtctggccctttacagaagtctgctctagagggagaccccggcccatggggcaggaccactgggcgtgggcagaagggaggcctcggtgcctccacgggcctagttgggtatctcagtgcctgtttcttgcatggagcaccaggggtcagggcaagtacctggaggaggcaggctgttgcccgcccagcactgggacccaggagaccttgagaggctcttaacgaatgggagacaagcaggaccagggctcccattggctgggcctcagtttccctgcctgtaagtgagggagggcagctgtgaaggtgaactgtgaggcagagcctctgctcagccattgcaggggcggctctgccccactcctgttgtgcacccagagtgaggggcacggggtgagatgtcaccatcagcccataggggtgtcctcctggtgccaggtccccaagggatgtcccatcccccctggctgtgtggggacagcagagtccctggggctgggagggctccacactgttttgtcagtggtttttctgaactgttaaatttcagtggaaaattctctttccccttttactgaaggaacctccaaaggaagacctgactgtgtctgagaagttccagctggtgctggacgtcgcccagaaagcccaggtactgccacgggcgccggccaggggtgtgtctgcgccagccatgggcaccagccaggggtgtgtctacgccggccaggggtaggtctccgccggcctccgctgctgcctggggagggccgtgcctgacactgcaggcccggtttgtccgcggtcagctgacttgtagtcaccctgcccttggatggtcgttacagcaactctggtggttggggaaggggcctcctgattcagcctctgcggacggtgcgcgagggtggagctcccctccctccccaccgcccctggccagggttgaacgcccctgggaaggactcaggcccgggtctgctgttgctgtgagcgtggccacctctgccctagaccagagctgggccttccccggcctaggagcagccgggcaggaccacagggctccgagtgacctcagggctgcccgacctggaggccctcctggcgtcgcggtgtgactgacagcccaggagcgggggctgttgtaattgctgtttctccttcacacagaaccttttcgggaagatggctgacatcctggagaagatcaagaagtaagtcccgccccccaccc

SEQ ID NO: 30 - DNA, 1851 bp, Artificial Sequence
  sequence of STAR30
cctcccctggagccttcagaaggagcatggcataggagtcttgatttcagacgtctggtccccagaatgatgggagaatgaatttctgttatttaagccacccaacctgtggtgctttgttatagcagcctcaggaaactaacacactgcacgtgcccactattcccttttccagtatctttcaggacttgctggcttcctttgttctggcgtacacccatgcatggccccattccccacttcctaaaacaacaaccctgacttagtctgtttgggctgctagaacaaaatactatagactgggtgacttataaacaacagaaattcatttctcacattctggaggctgggaagtccaatatcgaggcaccatcacatttggtctctgctgaggcccccttcctagctcctcactgtgtccttacatggcagaaggggcaaggcagctctctggggtcccttttcaaggccacaaatcccattcattagggctgatgacttcatgacttaatcacctcctaatggccccacctcctaatcgcattgggcgttaggattcaacataaattttggggggacacacatattcagaccatagcaaaccccaacaataaaaaaccttcactttaaggttccaaatggactggcagttaaatcatgttcatatttacataaaagaaggagtaagtcaacaaattgataaacgcgtggagatttgttcggatggatgttcaccaaaatgctggccttaaagagtgagatgggaaatgggaactattacattcttcttcatactttttggtactgcctgcattgttaaaaaaaaaaaaaaagagcacagagcatttttacaatcaggaaaaaaacaatgaggttatcttcattctggaaaaaaatggaaaatgaaacagtggagtcacatcatggaaaatgcttatggtacaatttcatgtgacataaaacaatagaatagaggacctgttttatgactaaagcactgtaaaaatgacaggcctggaaggagagatgaaaaccactcatttgttaaggtagtcaggtggcaggtgatttctcttcttttgaaaatttccattttcattatatcgcagtttgtgcatttactaaaactttcggttggtacacatgcataaatagatagataaataagtagatagatgatagataaatagacggtaggtagatagatagatagatatgagaaataagtcccctgtacttggccttgcagccataactagtcattccccttcctctgtccattgctatgcctgatggacaaggcagtctgtgccctctggccccaattccaatgtgccctctgctcctggctgttagtccctttccaccccaatacaattgctccgaggtcacttctaagtgtgaagcccccagatcagatggcttcttctgtgtccttaccttacccaatttctaattataactaaaacacaatgaggctctagtaaaataccatgagacttcaggccctctgtataacttcactcatttaaacctaacaaggaaaacctaccatgaatccgaggcacagagcagctaaggaactcaccaaggtcacgcagctattggtgatggaaccatgagtcaagcttcacagcctgttggctctagaatagggtttcccaacctcagcactgtggacattttcaggctggataattctctgttgtggggggctgttctgtgccttgtaggatattaggagcatctctggcctctacccactagacgcagcagcactcccatgcccagttgtgacaacaagcaatgtctcccaccattgccaagtgtcccctgggtggaaatgcaccc

SEQ ID NO: 31 - DNA, 1701 bp, Artificial Sequence
  sequence of STAR31
  misc_feature (159)..(1696): "N" stands for any nucleotide on various positions
cacccgccttggccccccagagtgctgggattacaagtgtaaaccaccattcctggctagatttaattttttaaaaaataaagagaagtaggaatagttcattttagggagagccccttaactgggacaggggcaggacaggggtgaggcttcccttanttcaagctcacctcaaacccacccaggactgtgtgtcacattctccaataaaggaaaggttgctgcccccgcctgtgagtgctgcagtggagggtagagggccgtgggcagagtgcttcatggactgctcatcaagaaaggcttcatgacaatcggcccagctgctgtcatcccacattctacttccagctaggagaaggcggcttgcccacagtcacccagccggcaagtgtcacccctgggttggacccagagctatgatcctgcccaggggtccagctgagaatcaggcccacgttctaggcagaggggctcacctactgggactccagtagctgtagtgcatggaggcatcatggctgcagcagcctggacctggtctcacactggctgtccctgtgggcaggccatcctcaatgccaggtcaggcccaagcatgtatcccagacaatgacaatggggtggaatcctctcttgtcccagaagccactcctcactgttctacctgaggaaggcaggggcatggtggaatcctgaagcctgctgtgagggtctccagcgaacttgcacatggtcagccctgccttctcctccctgaactagattgagcgagagcaagaaggacattgaaccagcacccaaagaattttggggaacggcctctcatccaggtcaggctcacctcctttttaaaatttaattaattaattaattaatttttttttagagacagagtcttactgtgtggcccaggctgtagtgcagtggcacaatcatagttcactgcagcctcaaactccccacctcagcctctggattagctgagactacaggtgcaccaccaccacacccagctaatatttttatttttgtagagagagggtttcaccatcttgcccaggctggtctcaaactcctgggctcaagtgatcccgcccaggtctgaaagcccccaggctggcctcagactgtggggttttccatgcagccacccgagggcgcccccaagccagttcatctcggagtccaggcctggccctgggagacagagtgaaaccagtggtttttatgaacttaacttagagtttaaaagatttctactcgatcacttgtcaagatgcgccctctctggggagaagggaacgtgactggattccctcactgttgtatcttgaataaacgctgctgcttcatcctgtgggggccgtggccctgtccctgtgtgggtggggcctcttccatttccctgacttagaaaccacagtccacctagaacagggtttgagaggcttagtcagcactgggtagcgttttgactccattctcggctttcttctttttctttccaggatttttgtgcagaaatggttcttttgttgccgtgttagtcctccttggaaggcagctcagaaggcccgtgaaatgtcgggggacaggacccccagggagggaaccccaggctacgcactttagggttcgttctccagggagggcgacctgacccccgnatccgtcggngcgcgnngnnacnaannnnttccc

SEQ ID NO: 32 - DNA, 771 bp, Artificial Sequence
  sequence of STAR32
gatcacacagcttgtatgtgggagctaggattggaaccccagaagtctggccccaggttcatgctctcacccactgcatacaatggcctctcataaatcaatccagtataaaacattagaatctgctttaaaaccatagaattagtagcgtaagtaataaatgcagagaccatgcagtgaatggcattcctggaaaaagcccccagaaggaattttaaatcagctttcgtctaatcttgagcagctagttagcaaatatgagaatacagttgttcccagataatgctttatgtctgaccatcttaaactggcgctgtttttcaaaaacttaaaaacaaaatccatgactcttttaattataaaagtgatacatgtctacttgggaggctgaggtggtgggaggatggcttgagtttgaggctgcagtatgctactatcatgcctataaatagccgctgcattccagcttgggcaacatacccaggccctatctcaaaaaaataaaaagtaatacatctacattgaagaaaattaattttattgggtttttttgcatttttattatacacagcacacacagcacatatgaaaaaatgggtatgaactcaggcattcaactggaagaacagtactaaatcaatgtccatgtagtcagcgtgactgaggttggtttgttttttcttttttcttctcttctcttctcttttctttttttttgagacggagctttgctctttttgcccaggcttgattgcaatggcgtgatctcag

SEQ ID NO: 33 - DNA, 1368 bp, Artificial Sequence
  sequence of STAR33
gcttttatcctccattcacagctagcctggcccccagagtacccaattctccctaaaaaacggtcatgctgtatagatgtgtgtggcttggtagtgctaaagtggccacatacagagctctgacaccaaacctcaggaccatgttcatgccttctcactgagttctggcttgttcgtgacacattatgacattatgattatgatgacttgtgagagcctcagtcttctatagcacttttagaatgctttataaaaaccatggggatgtcattatattctaacctgttagcacttctgttcgtattacccatcacatcccaacatcaattctcatatatgcaggtacctcttgtcacgcgcgtccatgtaaggagaccacaaaacaggctttgtttgagcaacaaggtttttatttcacctgggtgcaggtgggctgagtctgaaaagagagtcagtgaagggagacaggggtgggtccactttataagatttgggtaggtagtggaaaattacaatcaaagggggttgttctctggctggccagggtgggggtcacaaggtgctcagtgggagagcctttgagccaggatgagccagaaggaatttcacaaggtaatgtcatcagttaaggcagggactggccattttcacttcttttgtggtggaatgtcatcagttaaggcaggaaccggccattttcacttcttttgtgattcttcacttgcttcaggccatctggacgtataggtgcaggtcacagtcacaggggataagatggcaatggcatagcttgggctcagaggcctgacacctctgagaaactaaagattataaaaatgatggtcgcttctattgcaaatctgtgtttattgtcaagaggcacttatttgtcaattaagaacccagtggtagaatcgaatgtccgaatgtaaaacaaaatacaaaacctctgtgtgtgtgtgtgtgtgagtgtgtgtgtatgtgtgtgtgtgtgtattagagaggaaaagcctgtatttggaggtgtgattcttagattctaggttctttcctgcccaccccatatgcacccaccccacaaaagaacaaacaacaaatcccaggacatcttagcgcaacatttcagtttgcatattttacatatttacttttcttacatattaaaaaactgaaaattttatgaacacgctaagttagattttaaattaagtttgtttttacactgaaaataatttaatatttgtgaagaatactaatacattggtatatttcattttcttaaaattctgaacccctcttcccttatttccttttgacccgattggtgtattggtcatgtgactcatggatttgccttaaggcaggagg

SEQ ID NO: 34 - DNA, 755 bp, Artificial Sequence
  sequence of STAR34
actgggcaccctcctaggcaggggaatgtgagaactgccgctgctctggggctgggcgccatgtcacagcaggagggaggacggtgttacaccacgtgggaaggactcagggtggtcagccacaaagctgctggtgatgaccaggggcttgtgtcttcactctgcagccctaacacccaggctgggttcgctaggctccatcctgggggtgcagaccctgagagtgatgccagtgggagcctcccgcccctccccttcctcgaaggcccaggggtcaaacagtgtagactcagaggcctgagggcacatgtttatttagcagacaaggtggggctccatcagcggggtggcctggggagcagctgcatgggtggcactgtggggagggtctcccagctccctcaatggtgttcgggctggtgcggcagctggcggcaccctggacagaggtggatatgagggtgatgggtggggaaatgggaggcacccgagatggggacagcagaataaagacagcagcagtgctggggggcagggggatgagcaaaggcaggcccaagacccccagcccactgcaccctggcctcccacaagccccctcgcagccgcccagccacactcactgtgcactcagccgtcgatacactggtctgttagggagaaagtccgtcagaacaggcagctgtgtgtgtgtgtgcgtgtatgagtgtgtgtgtgtgatccctgactgccaggtcctctgcactgcccctggg

SEQ ID NO: 35 - DNA, 1193 bp, Artificial Sequence
  sequence of STAR35
  misc_feature (355)..(1191): "N" stands for any nucleotide on various positions
  misc_feature (312)..(1191): "N" stands for any nucleotide on various positions
cgacttggtgatgcgggctcttttttggttccatatgaactttaaagtagtcttttccaattctgtgaagaaagtcattggtaggttgatggggatggcattgaatctgtaaattaccttgggcagtatggccattttcacaatgttgattcttcctatccatgatgatggaatgttcttccattagtttgtatcctcttttatttccttgagcagtggtttgtagttctccttgaagaggtccttcacatcccttgtaagttggattcctaggtattttattctctttgaagcaaattgtgaatgggagtncactcacgatttggctctctgtttgtctgctgggtgtataaanaatgtngtgatnttngtacattgatttngtatccntgagacttngctgaatttgcttnatcngcttnngggaaccttttgggctgaaacnatgggattttctaaatatacaatcatgtcgtctgcaaacagggaacaatttgacttcctcttttcctaattgaatacactttatctccttctcctgcctaattgccctgggcaaaacttccaacactatgntngnaataggagntggtgagagagggcatccctgttcttgttgccagnttttcaaagggaatgcttccagttttggcccattcagtatgatatgggctgtgggtngtgtcataaatagctcttatnattttgaaatgtgtcccatcaatacctaatttattgaaagtttttagcatgaangcatngttgaatttggtcaaaggctttttctgcatctatggaaataatcatgtggtttttgtctttggctcntgtttatatgctggatnacatttattgatttgtgtatatngaacccagcctnncatcccagggatgaagcccacttgatccaagcttggcgcgcngnctagctcgaggcaggcaaaagtatgcaaagcatgcatctcaattagtcagcacccatagtccgcccctacctccgcccatccgcccctaactcngnccgttcgcccattctcgcccatggctgactaatntttttannatccaagcggngccgccctgcttgancattcagagtnnagagnnttggaggccnagccttgcaaaactccggacngnttctnnggattgaccccnnttaaatatttggttttttgtnttttcannggnga

SEQ ID NO: 36 - DNA, 1712 bp, Artificial Sequence
  sequence of STAR36
gatcccatccttagcctcatcgatacctcctgctcacctgtcagtgcctctggagtgtgtgtctagcccaggcccatcccctggaactcaggggactcaggactagtgggcatgtacacttggcctcaggggactcaggattagtgagccccacatgtacacttggcctcagtggactcaggactagtgagccccacatgtacacttggcctcaggggactcaggattagtgagcccccacatgtacacttggcctcaggggactcaggattagtgagccccacatgtacacttggcctcaggggactcaggactagtgagccccacatgtacacttggcctcaggggactcagaactagtgagccccacatgtacacttggcttcaggggactcaggattagtgagccccacatgtacacttggacacgtgaaccacatcgatgtgctgcagagctcagccctctgcagatgaaatgtggtcatggcattccttcacagtggcacccctcgttccctccccacctcatctcccattcttgtctgtcttcagcacctgccatgtccagccggcagattccaccgcagcatcttctgcagcacccccgaccacacacctccccagcgcctgcttggccctccagcccagctcccgcctttcttccttggggaagctccctggacagacaccccctcctcccagccatggctttttcctgctctgccccacgcgggaccctgccctggatgtgctacaatagacacatcagatacagtccttcctcagcagccggcagacccagggtggactgctcggggcctgcctgtgaggtcacacaggtgtcgttaacttgccatctcagcaactagtgaatatgggcagatgctaccttccttccggttccctggtgagaggtactggtggatgtcctgtgttgccggccaccttttgtccctggatgccatttatttttttccacaaatatttcccaggtctcttctgtgtgcaaggtattagggctgcagcgggggccaggccacagatctctgtcctgagaagacttggattctagtgcaggagactgaagtgtatcacaccaatcagtgtaaattgttaactgccacaaggagaaaggccaggaaggagtggggcatggtggtgttctagtgttacaagaagaagccagggagggcttcctggatgaagtggcatctgacctgggatctggaggaggagaaaaatgtcccaaaagagcagagagcccaccctaggctctgcaccaggaggcaacttgctgggcttatggaattcagagggcaagtgataagcagaaagtccttgggggccacaattaggatttctgtcttctaaagggcctctgccctctgctgtgtgaccttgggcaagttacttcacctctagtgctttggttgcctcatctgtaaagtggtgaggataatgctatcacactggttgagaattgaagtaattattgctgcaaagggcttataagggtgtctaatactagtactagtaggtacttcatgtgtcttgacaattttaatcattattattttgtcatcaccgtcactcttccaggggactaatgtccctgctgttctgtccaaattaaacattgtttatccctgtgggcatctggcgaggtggctaggaaagcctggagctgtttcctgttgacgtgccagactagt

SEQ ID NO: 37 - DNA, 1321 bp, Artificial Sequence
  sequence of STAR37
atctctctctgccaaagcaacagcggtccctgccccaaccagactaccccactcagtggggttacggatgctgctccagcatcctaacactgcccagctggtgcctgcctgtgctcacccacaacccccaggccggccttccctgcagcctgggcttggccaccttggcctgattgagcactgaggcctcctgggcacccagccccatcactgcacctgctgcttccagccccaccccaccggctcaggggttcttcccagcggcgctgatcatgaagtcaacatgcacgcaagtcgtctcaggaaactttttaatgaaagtgtcggccacggtggtgtgtaggtggctgagctcagattgcagctgctaagacaccagccacttaccaagagaaagccaggctgcttcaaacccagggccggaggcaaaaaagcatcacttccagccggggagtctggaagccacgccttgtgggaggtcacactggcatctaggccttcgcctgcactgcagaaggagagccgggtccccctcctggagaacgctgcgttccccagccccacaccggctttgccaccacacaggctgttgaggcaggaggcgggtaagacgtagctgtagacccaaagcaaccaccagccctgggaccctgcgggagaggagcacttttagaacatggaaaaatgtggtcatcccatcattagacagcacacatcctacataaataaaaagtcgtatggggaaggaggttggggagggaataaaaaattggcacagacattgatagactggtttccagtttcaaggtaacagatgcacatcatgagaccagaggaggcagagacaagggctgaatttggcttttctaagcaacatgtgttcctgcgcagggctgaatggtcgctgagacagagatggaagccaggacaagggagcccaccgggcccagataggtacagagagcagaggctcctgttctgtcctcgccacccatgagggtgacactgcttgtaaatggtggctgtgctctcccagcaagaaaaaagcacaactaaatccacactgcacacagacgcagacagaaagccttcaagtggctctgttttctgctccctgccttgccaggtccacaagcagagaggagtgtcaggcacatggccccgctgtcaggctccccagtgagctgtaggctcagcaggagctgcccactgacacacaggggacacccactcctgccaccttgggagcggttgccagacagagccgcactgggtgctggtgtcatccagggaccccacacacttccttaaatgtgatcct

SEQ ID NO: 38 - DNA, 1445 bp, Artificial Sequence
  sequence of STAR38
  misc_feature (348)..(949): "N" stands for any nucleotide on various positions
gatctatgggagtagcttccttagtgagctttcccttcaaatactttgcaaccaggtagagaattttggagtgaaggttttgttcttcgtttcttcacaatatggatatgcatcttcttttgaaaatgttaaagtaaattacctctcttttcagatactgtcttcatgcgaacttggtatcctgtttccatcccagccttctataacccagtaacatcttttttgaaaccagtgggtgagaaagacacctggtcaggaacgcggaccacaggacaactcaggctcacccacggcatcagactaaaggcaaacaaggactctgtataaagtaccggtggcatgtgtatnagtggagatgcagcctgtgctctgcagacagggagtcacacagacacttttctataatttcttaagtgctttgaatgttcaagtagaaagtctaacattaaatttgattgaacaattgtatattcatggaatattttggaacggaataccaaaaaatggcaatagtggttctttctggatggaagacaaacttttcttgtttaaaataaattttattttatatatttgaggttgaccacatgaccttaaggatacatatagacagtaaactggttactacagtgaagcaaattaacatatctaccatcgtacatagttacatttttttgtgtgacaggaacagctaaaatctacgtatttaacaaaaatcctaaagacaatacatttttattaactatagccctcatgatgtacattagatcgtgtggttgtttcttccgtccccgccacgccttcctcctgggatggggattcattccctagcaggtgtcggagaactggcgcccttgcagggtaggtgccccggagcctgaggcgggnactttaanatcagacgcttgggggccggctgggaaaaactggcggaaaatattataactgnactctcaatgccagctgttgtagaagctcctgggacaagccgtggaagtcccctcaggaggcttccgcgatgtcctaggtggctgctccgcccgccacggtcatttccattgactcacacgcgccgcctggaggaggaggctgcgctggacacgccggtggcgcctttgcctgggggagcgcagcctggagctctggcggcagcgctgggagcggggcctcggaggctgggcctggggacccaaggttgggcggggcgcaggaggtgggctcagggttctccagagaatccccatgagctgacccgcagggcggccgggccagtaggcaccgggcccccgcggtgacctgcggacccgaagctggagcagccactgcaaatgctgcgctgaccccaaatgctgtgtcctttaaatgttttaattaagaataattaataggtccgggtgtggaggctcaagccttaatccccagcacctggcgaggccgaggaggga

SEQ ID NO: 39 - DNA, 2331 bp, Artificial Sequence
  sequence of STAR39
tcactgcaacctccacctcccaggttcaagtgattctcctgcctcggcctcccgagtagctgggactacaggtgcatgacaccgcacctggctagtttttgtatttttagtagagacagggtttcactatgttggccaggttggtctcgaactcctgaccttgtgatccgcccacctcggcctcccaaagtgctgggattacagagtgagccactgcgcctggcctgcaccccttactattatatgctttgcattttcttttagatttgaagaacctcattataaactctagcactaatcttatgtcagttaaatgcatagcaaatatctcctgacgtgggagaatatatatttgcaagtcttcttgtgaacatatgttttcagttctagggagccagacgcctatgagtgaaaagcctagtcatcgtggagaagtgcattcaactttgtaagaaactgccaaacctttattcataatggttgtataaattttacattaccaccaataatgtatgagagttccagttgcttcacatcctcaccagcattttgttttgtctgtcttttttcctttggttattctagtgggcataagatataatagtatcccttgtggtttaatgtaaattccactgaagactaataacatttgcatatttctaattaataagcctttttaagtgacttttcaagtctttgctcatttttattagatatttgccttcttattattgatttgaaagaattatatttatatgcttatattctggttataagccctttgtcattattttccaaaacaatatttggttgtttctgtactactttccttgctcctttgaattgacttggtgccttggccaaaaatcaattgaccacatacatgtgggtgcatctccagactaccacattccgtttatctatttgtctctccttgtgtcaataacactctgtcttgataatggtaagttttgagatcaggttgtgtaagtcctcctaatttttcctgggttttcaatattgctttgctttttaaaaattttgtattttcatttacattttaaaataaacttgttagtgggattttgattggcattgcactgaactcgtggatcaatttggggagattggacattcttatatatggatcccgtggtcatcaactttaagaactctttctcatccattagtaactcaatctaggttcagatgctactcgttttctgctcagtctgtgtctgagccccttatgctcttcattttgtcatccaattaacctcagctttgcatcaatactatttcttgctttggtgcctgttacctctcctctaatcaccaatccacaacttacctccaaattcagggcttgtctcattcttcccaggaggagtgctgctcagtctatctacttagtattataatttctctggcttggtatcaaggcactcccatttccggcttccatgagatgtctcagagggcatgctgcccggtgtagctgcatggtcaagcttcttcatatctcttgcctcatcacttaaactcactattttgtactcctgcttcagctatagggagctactgttagtttcttgaagacatatgctctctctctctctcacatctggacctgagcacatcctgttactgctgcttgaaacaatgtgatccccaggcacacaccattagcttagaagcctcccctgattcttcaaggctggttgagtcccttctctgtgctctcatgacaacagttggcaattcctcgttgcagcacctagcccatgatgctctttggaggcagagactgagtctttctcactattgaatttccagcattcatcacagagcctggcatatataaagccctccatcatatgtattaagtgaatggataaatgaaaaaaagttatatatatgtacatatatgtgtatatatgtatatgtatatatgtgtatatatgtgtgtatatgtgtgtgtatatatgtacatatatatgtatctatgtacatatatgtatatatgtatatatatgtgtgtgtatatgtgtgtgtgtatgtatatatattacaatgaaatactattcagccttaaaaaggcagggaatcctgtcatttaacacaatatggataaacctagaggactctaaaggcaaataccacatgttctcactcacaaaatctaaacaagttgaactcctacaagtagagagtaggatgatggttaccaagggctgggggacgggagaggatggggaaagcatagctgtccatcaaagggtagaaagtttcatttagacaagaggaatcagctttagtgatctatttcac

SEQ ID NO: 40 - DNA, 1071 bp, Artificial Sequence
  sequence of STAR40
gctgtgattcaaactgtcagcgagataaggcagcagatcaagaaagcactccgggctccagaaggagccttccaggccagctttgagcataagctgctgatgagcagtgagtgtcttgagtagtgttcagggcagcatgttaccattcatgcttgacttctagccagtgtgacgagaggctggagtcaggtctctagagagttgagcagctccagccttagatctcccagtcttatgcggtgtgcccattcgctttgtgtctgcagtcccctggccacacccagtaacagttctgggatctatgggagtagcttccttagtgagctttcccttcaaatactttgcaaccaggtagagaattttggagtgaaggttttgttcttcgtttcttcacaatatggatatgcatcttcttttgaaaatgttaaagtaaattacctctcttttcagatactgtcttcatgcgaacttggtatcctgtttccatcccagccttctataacccagtaacatcttttttgaaaccagtgggtgagaaagacacctggtcaggaacgcggaccacaggacaactcaggctcacccacggcatcagactaaaggcaaacaaggactctgtataaagtaccggtggcatgtgtattagtggagatgcagcctgtgctctgcagacagggagtcacacagacacttttctataatttcttaagtgctttgaatgttcaagtagaaagtctaacattaaatttgattgaacaattgtatattcatggaatattttggaacggaataccaaaaaatggcaatagtggttctttctggatggaagacaaacttttcttgtttaaaataaattttattttatatatttgaggttgaccacatgaccttaaggatacatatagacagtaaactggttactacagtgaagcaaattaacatatctaccatcgtacatagttacatttttttgtgtgacaggaacagctaaaatctacgtatttaacaaaaatcctaaagacaatacatttttattaactatagccctcatgatgtacattagatctctaa

SEQ ID NO: 41 - DNA, 1135 bp, Artificial Sequence
  sequence of STAR41
tgctcttgttgcccaggctgcagtgcaatggcgctgtctcggctcatcgcaacctccgcctcccagattcaagtgattctcctgcctcaccctcccaagtagctgggattaccagtatgcagcaacacgcccggctaattttgtatttgtaatagagacggggtttcttcatgttggtcaggctggtctcaaattcctgccctcaggtgatctgcccaccttggcctcccaaagtgctgggattacaggcatgagccactgtgcccggcctgggctggggcttttaaggggactggagggtgaggggctggaaaattgggagagttgattggtggggcaagggggatgtaatcatcagggtgtacaaactgcactcttggtttagtcagctcctcgtggggtccttcggagcagctcagtcagtagctccatcagtatacaggacccaaaggaatatctcaaagggaaaacagcatttcctaaggttcaagttgtgatctacggagcagttaggggaactacaatcttgtgacagggtctacatgcttctgaggcaatgagacaccaagcagctacgaggaagcagtcagagagcacgccgacctagtgactgatgctgatgtgctgcgagctgggttcattttcatttctcccctccccctgccctcattaattttgtaaagtttatagggaacatttcacccactctgctgtggatccctgtcacttacggagtctgtcatcttggctgtatgggctgtggcctctgcggtgcccattctcaggaggtgtgagacccatgaggaccggaggtggacaaggctagagaccacacccccccgctccatccaatcatgttttcctgggtgcttggtttctatgcaggctgcatgtccttagtccctgcatgggaacagctcctgtggtgagcaggcccctgaggaaggccttgagcgggaatggagcctaggcttaggctgcctggtaagagctggagggaaccagccgaggcttgtgctacttttttttccagaatgaaatacgtgactgatgttggtgtcctgcagcgccacgtttcccgccacaaccaccggaacgaggatgaggagaacacactctccgtggactgcacacg

SEQ ID NO: 42 - DNA, 735 bp, Artificial Sequence
  sequence of STAR42
aagggtgagatcactagggagggaggaaggagctataaaagaaagaggtcactcatcacatcttacacactttttaaaaccttggttttttaatgtccgtgttcctcattagcagtaagccctgtggaagcaggagtctttctcattgaccaccatgacaagaccctatttatgaaacataatagacacacaaatgtttatcggatatttattgaaatataggaatttttcccctcacacctcatgaccacattctggtacattgtatgaatgaatataccataattttacctatggctgtatatttaggtcttttcgtgcaggctataaaaatatgtatgggccggtcacagtgacttacgcccgtagtcccagaactttgggaggccgaggcgggtggatcacctgaggtcgggagttcaaaaccagcctgaccaacatggagaaaccccgtctctgctaaaaatacaaaaattaactggacacggtggcgtatgcctgtaatcccagctactcgggaagctgaggcaggagaactgcttgaacccaggaggcggaggttgtggtgagtcgagattgcgccattgcactccagcctgggcaacaagagcgaaattccatctcaaaaaaaagaaaaaagtatgactgtatttagagtagtatgtggatttgaaaaattaataagtgttgccaacttaccttagggtttataccatttatgagggtgtcggtttc

SEQ ID NO: 43 - DNA, 1227 bp, Artificial Sequence
  sequence of STAR43
caaatagatctacacaaaacaagataatgtctgcccatttttccaaagataatgtggtgaagtgggtagagagaaatgcatccattctccccacccaacctctgctaaattgtccatgtcacagtactgagaccagggggcttattcccagcgggcagaatgtgcaccaagcacctcttgtctcaatttgcagtctaggccctgctatttgatggtgtgaaggcttgcacctggcatggaaggtccgttttgtacttcttgctttagcagttcaaagagcagggagagctgcgagggcctctgcagcttcagatggatgtggtcagcttgttggaggcgccttctgtggtccattatctccagcccccctgcggtgttgctgtttgcttggcttgtctggctctccatgccttgttggctccaaaatgtcatcatgctgcaccccaggaagaatgtgcaggcccatctcttttatgtgctttgggctattttgattccccgttgggtatattccctaggtaagacccagaagacacaggaggtagttgctttgggagagtttggacctatgggtatgaggtaatagacacagtatcttctctttcatttggtgagactgttagctctggccgcggactgaattccacacagctcacttgggaaaactttattccaaaacatagtcacattgaacattgtggagaatgagggacagagaagaggccctagatttgtacatctgggtgttatgtctataaatagaatgctttggtggtcaactagacttgttcatgttgacatttagtcttgccttttcggtggtgatttaaaaattatgtatatcttgtttggaatatagtggagctatggtgtggcattttcatctggctttttgtttagctcagcccgtcctgttatgggcagccttgaagctcagtagctaatgaagaggtatcctcactccctccagagagcggtcccctcacggctcattgagagtttgtcagcaccttgaaatgagtttaaacttgtttatttttaaaacattcttggttatgaatgtgcctatattgaattactgaacaaccttatggttgtgaagaattgatttggtgctaaggtgtataaatttcaggaccagtgtctctgaagagttcatttagcatgaagtcagcctgtggcaggttgggtggagccagggaacaatggagaagctttcatgggtgg

SEQ ID NO: 44 - DNA, 1586 bp, Artificial Sequence
  sequence of STAR44
tgagttggggtcctaagccagaagttaactatgctttcatatattcttgcaagtagaagtacagtgttggtgtaaattccccttagatggatagctaagcccagaggaaataatggtaattggaaccatatgaccgtatgcaattcatgtgcatatttatatcaagaaaagaacattataggtcgggtgagaccctattttgttctgacaatgtcatctgtatttacatgtctgtttcgggagtttggatgtcaagggattctgtgctggattgtaaagcatgtgcttctgcttgatgtagctactcaattttgtattcttgactaataaagtcataaacataattcaacctctgtgtgcgtgctctccttccattaatttatactttagcaaaaagtattgaatgtgtgtgttatgtaacaatttcctataaattatattaaatgatttattagctttattcaataaagttttaagtgttttcttctatgactacattatttgttaacaagaaatttctttaactgaaaacttcaaggaagactatctgggtaactctttcaaaaagaattgtccctgtattttgggattgaatatattaatttcttgtactgttttaacagcacataattttacaagacaagccactttttcaaagcctgcttctcctcccattttccctatctctgtgattgacacctccaacccctgtagcctgcctctgctctctcttaaccagtcctactgatactacttcctaagtatttttcagccctgtccttcctctccatcatgatggattcacttccagttgaaatccttatggtaccctccctggattatggcagtaatcagagagctggtctccttaactcaggattcacttcttctcatctgttgttcacagtgacatcagaaagatattttaaaatgatgaactagaattaattatataaaacacacatacacacataaataatacttaaatttttcaatgatgttccaattatgtaaaatataatataggaggcactttatgttctggcctcaatctttcaattcaaacttatctcctgccactatctcctttgaacattgtattccagctactttagaataataataatacataatattcatagagcccttcctgggttcctatcaccgtacaaaatacttcacatataacatttaatctttgacaactttattaggcatgcacaattattatctatctatatatctatatctatatatataaaatctatattttatagataagaaaatagagggtaaaaacttgccaaaattacaaagcttagaagtgtagcagttgggatttgaatctaggcatcctgcctctatagtctacagtggctttcttgtgccaaaagccttgcagttccctagacttaacatttctcaaaatctgtgtctttcacatgctcttccaattgtctggaaaatctttcccaacctcagtctaactgtggtactcatgttcaccccacaagaattgactccatctgtcccctctccatgaaaatttctttgaatctcagcactttgggaggctgaggcaggtg

SEQ ID NO: 45 - DNA, 1981 bp, Artificial Sequence
  sequence of STAR45
cacgccccagcgtgccctggactactgctccgcaggactcctgttctgctgcaccctggactacggcaccagaggacccagctcccgccggcctgagctatggcaccagaggacccagctcccggcagcctggactatggcaccagaggacccagccccccgcttcctgggctaaggcacagtaggaccctgcctcatcgtgtactcctgctcaggaggaccctcgcagggcggcgcactggactaagctactgaaggagccccacccctgcctaaccctggactaaggcactggagaactcttgctccgcagagccacggactcttgcacaagagaacctcagcccagccgtgccctggactgtggcacagtagggcccacaccacgccatggactcctgtattggaggaagagtagtgataaatgtccaggtttacaacttgaaaagtagcaatcaatgtgccacaatagatggatgtgatgtaaaattataaatgatgaaaacattatgtgtaattgcctagccagaacagttacacaagacaaagacgtaaaagaaatccacatagggaaggaagaggtaagattgtttctgttttttgaaaatataatcttaagatagagaaaatcttaaagattccaccaaaataaatggttatagctgatgaagaaattcaataaagttaatagttacaaaatcaacatacaaatatcattattgtttctattaactaatgacaaactattacctgaaaaataaaggcaattcaatttataatagaatcaaaacagatatataaatatataaaagacaggagtaaatttaatcaaaaccataaaagatttacatactgaaaactatagcacattgatgaaaaaaattaaaatggcataaataaatggagaaacatccttcattgatggattcaaaaattagtattgtaaaagtgtcaatgctacccaaagcaatctacagattaaatgcaaccactatcaaattccaatgtcattcttcacagaaatagaaaaattactgctaaaatttgtatggaaccacaaaagacctggaccaaccaaagcaatcttgaacaaaaagaacaaagctggaggcatcagactacctgactccaaactctattacaaagctataggaattaaaacagcatagcaatggcataaaaacagacatgtaaaacagtacaaagggatatagaacctgtaaataaatccgtgtgtctgtggtcaattgattttttgataaaataactaaaaatacacagtgaagaaagaaaattattttcaataaatggtgtagacaaaactgactatccacatacagaagaataaaatttgacttttattttgctctttatacaagcatcaaatcaaaattaaagtttaaatgtaaaactactacaaggaaatatagaaggagactgtatgacattggcctgagctatgattttctgtagattattccaaaaggcaacaaaagcaaaacacacaaatgagactgcataaaacttaaaacttttccacaggaaaagaagcaatgatagaattaagagaacccacaaatgggataatatttttaaaccatacatcaggtaaggggctcatataataatatataagcaactcaacctactcaaaaataagaaaaaaactatgcttattaaaaaataagcaaagaatcagaatagacatttcctacatcatacaaaaggccaaccaggtacatgaaaaaatcataaacattcctaattatcagagaagtgcaaatcaatgccacaatgagatatcacctcacacattttactagggctattataaaaaaagatggaagataagtgttggtgaggatgtggagaaaaagaaaccctgtacactgttggtaggaatggaaattagtacagccatcttggaaaacagtacgaagctttctcaagaaattataaatttatttaccctatgatccat

SEQ ID NO: 46 - DNA, 1859 bp, Artificial Sequence
  sequence of STAR46
attgtttttctcgcccttctgcattttctgcaaattctgttgaatcattgcagttacttaggtttgcttcgtctcccccattacaaactacttactgggtttttcaaccctagttccctcatttttatgatttatgctcatttctttgtacacttcgtcttgctccatctcccaactcatggcccctggctttggattattgttttggtcttttattttttgtcttcttctacctcaacacttatcttcctctcccagtctccggtaccctatcaccaaggttgtcattaacctttcatattattcctcattatccatgtattcatttgcaaataagcgtatattaacaaaatcacaggtttatggagatataattcacataccttaaaattcaggcttttaaagtgtacctttcatgtggtttttggtatattcacaaagttatgcattgatcaccaccatctgattccataacatgttcaatacctcaaaaagaagtctgtactcattagtagtcatttcacattcaccactccctctggctctgggcagtcactgatctttgtgtctctatggatttgcctagtctaggtatttttatgtaaatggcatcatacaacatgtgaccttttgtttggcttttttcatttagcaaaatgttatcaaggtctgtccctgttgtagcatgtattagcacttcatttcttatatgctgaatgatatactttatttgtccatcagttgttcatgctttatttgtccatcagttgatgaacatttgcgtttttgccactttgggctattaagaataatgctactgtgaacaagtgtgtacaagttcctctacaaatttttgtgtggacatatcctttcagttctctcaggtgtatatctgggaattgaattgctgggtcgtgtagtagctatgttaaacactttgagaaactgctataatgttctccagagctgtaccattttaaattctgtgtatgaggattccacgttctccacttcctcaccagtgtatggatttgggggtatactttttaaaaagtgggattaggctgggcacagtggctcacacctgtaatcccaacacttcaggaagctgaggtgggaggatcacttgagcctagtagtttgagaccagcctgggcaacatagggagaccctgtctctacaaaaaataatttaaaataaattagctgggcgttgtggcacacacctgtagtcccagctacatgggaggctgaggtggaaggattccctgagcccagaagtttgaggttgcagtgagccatgatggcagcactatactgtagcctgggtgtcagagcaagactccgtttcagggaagaaaaaaaaaagtgggatgatatttttgacacttttcttcttgttttcttaatttcatacttctggaaattccattaaattagctggtaccactctaactcattgtgtttcatggctgcatagtaatattgcataatataaatataccattcattcatcaaagttagcagatattgactgttaggtgccaggcactgctctaagcgttaaagaaaaacacacaaaaacttttgcattcttagagtttattttccaatggagggggtggagggaggtaagaatttaggaaataaattaattacatatatagcatagggtttcaccagtgagtgcagcttgaatcgttggcagctttcttagtagtataaatacagtactaaagatgaaattactctaaatggtgttacttaaattactggaataggtattactattagtcactttgcaggtgaaagtggaaacaccatcgtaaaatgtaaaataggaaacagctggttaatgtt

SEQ ID NO: 47 - DNA, 1082 bp, Artificial Sequence
  sequence of STAR47
atcattagtcattagggaaatgcaaatgaaaaacacaagcagccaccaatatacacctactaggatgatttaaaggaaaataagtgtgaagaaggacgtaaagaaattgtaaccctgatacattgatggtagaaatggataaagttgcagccactgtgaaaaacagtctgcagtggctcagaaggttaaatatagaacccctgttggacccaggaactctactcttaggcaccccaaagaatagagaacagaaatcaaacagatgtttgtatactaatgtttgtagcatcacttttcacaggagccaaaaggtggaaataatccaaccatcagtgaacaaatgaatgtaataaaagcaaggtggtctgcatgcaatgctacatcatccatctgtaaaaaacgaacatcattttgatagatgatacaacatgggtggacattgagaacattatgcttagtgaaataagccagacacaaaaggaatatattgtataattgtaattacatgaagtgcctagaatagtcaaattcatacaagagaaagtgggataggaatcaccatgggctggaaatagggggaaggtgctatactgcttattgtggacaaggtttcgtaagaaatcatcaaaattgtgggtgtagatagtggtgttggttatgcaaccctgtgaatatattgaatgccatggagtgcacactttggttaaaaggttcaaatgataaatattgtgttatatatatttccccacgatagaaaacacgcacagccaagcccacatgccagtcttgttagctgccttcctttaccttcaagagtgggctgaagcttgtccaatctttcaaggttgctgaagactgtatgatggaagtcatctgcattgggaaagaaattaatggagagaggagaaaacttgagaatccacactactcaccctgcagggccaagaactctgtctcccatgctttgctgtcctgtctcagtatttcctgtgaccacctcctttttcaactgaagactttgtacctgaaggggttcccaggtttttcacctcggcccttgtcaggactgatcctctcaacta

SEQ ID NO: 48 - DNA, 1242 bp, Artificial Sequence
  sequence of STAR48
atcatgtatttgttttctgaattaattcttagatacattaatgttttatgttaccatgaatgtgatattataatataatatttttaattggttgctactgtttataagaatttcattttctgtttactttgccttcatatctgaaaaccttgctgatttgattagtgcatccacaaattttcttggattttctatgggtaattacaaatctccacacaatgaggttgcagtgagccaagatcacaccactgtactccagcctgggcgacagagtgagacaccatctcacaaaaacacataaacaaacaaacagaaactccacacaatgacaacgtatgtgctttctttttttcttcctctttctataatatttctttgtcctatcttaactgaactggccagaaaccccaggacaatgataaatacgagcagtgtcaacagacatctcattccctttcctagcttttataaaaataacgattatgcttcaacattacatatggtggtgtcgatggttttgttatagataagcttatcaggttaagaaatttgtctgcgtttcctagtttggtataaagattttaatataaatgaatgttgtattttatcatcttatttttttcctacatctgctaaggtaatcctgtgttttccccttttcaatctcctaatgtggtgaatgacattaaaataccttctattgttaaaatattcttgcaacgctgtatagaaccaatgcctttattctgtattgctgatggatttttgaaaaatatgtaggtggacttagttttctaaggggaatagaatttctaatatatttaaaatattttgcatgtatgttctgaaggacattggtgtgtcatttctataccatctggctactagaggagccgactgaaagtcacactgccggaggaggggagaggtgctcttccgtttctggtgtctgtagccatctccagtggtagctgcagtgataataatgctgcagtgccgacagttctggaaggagcaacaacagtgatttcagcagcagcagtattgcgggatccccacgatggagcaagggaaataattctggaagcaatgacaatatcagctgtggctatagcagctgagatgtgagttctcacggtggcagcttcaaggacagtagtgatggtccaatggcgcccagacctagaaatgcacatttcctcagcaccggctccagatgctgagcttggacagctgacgcct

SEQ ID NO: 49 - DNA, 1015 bp, Artificial Sequence
  sequence of STAR49
aaaccagaaacccaaaacaatgggagtgacatgctaaaaccagaaacccaaaacaatgggagggtcctgctaaaccagaaacccaaaacaatgggagtgaagtgctaaaaccagaaacccaaaacaatgggagtgtcctgctacaccagaaacccaaaacgatgggagtgacgtgataaaaccagacacccaaaacaatgggagtgacgtgctaaaccagaaacccaaaacaatgggagtgacgtgctaaaacctggaaacctaaaacaatgcgagtgaggtgctaacaccagaatccataacaatgtgagtgacgtgctaaaccagaacccaaaacaatgggagtgacgtgctaaaacaggaacccaaaacaatgagagtgacgtgctaaaccagaaacccaaaacaatgggaatgacgtgctaaaaccggaacccaaaacaatgggagtgatgtgctaaaccagaaacccaaaacaatgggaatgacatgctaaaactggaacccaaaacaatggtaactaagagtgatgctaaggccctacattttggtcacactctcaactaagtgagaacttgactgaaaaggaggatttttttttctaagacagagttttggtctgtcccccagagtggagtgcagtggcatgatctcggctcactgcaagctctgcctcccgggttcaggccattctcctgcctcagcctcctgagtagctgggaatacaggcacccgccaccacacttggctaattttttgtatttttagtagagatggggtttcaccatattagcaaggatggtctcaatctcctgacctcgtgatctgcccacctcaggctcccaaagtgctgggattacaggtgtgagccaccacacccagcaaaaaggaggaatttttaaagcaaaattatgggaggccattgttttgaactaagctcatgcaataggtcccaacagaccaaaccaaaccaaaccaaaatggagtcactcatgctaaatgtagcataatcaaa

SEQ ID NO: 50 - DNA, 2355 bp, Artificial Sequence
  sequence of STAR50
caaccatcgttccgcaagagcggcttgtttattaaacatgaaatgagggaaaagcctagtagctccattggattgggaagaatggcaaagagagacaggcgtcattttctagaaagcaatcttcacacctgttggtcctcacccattgaatgtcctcacccaatctccaacacagaaatgagtgactgtgtgtgcacatgcgtgtgcatgtgtgaaagtatgagtgtgaatgtgtctatatgggaacatatatgtgattgtatgtgtgtaactatgtgtgactggcagcgtggggagtgctggttggagtgtggtgtgatgtgagtatgcatgagtggctgtgtgtatgactgtggcgggaggcggaaggggagaagcagcaggctcaggtgtcgccagagaggctgggaggaaactataaacctgggcaatttcctcctcatcagcgagcctttcttgggcaataggggcagagctcaaagttcacagagatagtgcctgggaggcatgaggcaaggcggaagtactgcgaggaggggcagagggtctgacacttgaggggttctaatgggaaaggaaagacccacactgaattccacttagccccagaccctgggcccagcggtgccggcttccaaccataccaaccatttccaagtgttgccggcagaagttaacctctcttagcctcagtttccccacctgtaaaatggcagaagtaaccaagcttaccttcccggcagtgtgtgaggatgaaaagagctatgtacgtgatgcacttagaagaaggtctagggtgtgagtggtactcgtctggtgggtgtggagaagacattctaggcaatgaggactggggagagcctggcccatggcttccactcagcaaggtcagtctcttgtcctctgcactcccagccttccagagaggaccttcccaaccagcactccccacgctgccagtcacacatagttacacacatacaatcacatatatgttcccatatagacacattcacactcataccttcacacatgcacacgcatgtgcacacacagtcactcatttctgtgttggagattgggtgaggacattcaatgggtgaggaccaacaggtgtgaagattgctttctagaaaatgactcctgtctctctttgccattcttcccaatccgatggagctactaggcttttccctcatttcatgtttaataaaccttcccaatggcgaaatgggctttctcaagaagtggtgagtgtcccatccctgcggtggggacaggggtggcagcggacaagcctgcctggagggaactgtcaggctgattcccagtccaactccagcttccaacacctcatcctccaggcagtcttcattcttggctctaatttcgctcttgttttcttttttatttttatcgagaactgggtggagagcttttggtgtcattggggattgctttgaaacccttctctgcctcacactgggagctggcttgagtcaactggtctccatggaatttctttttttagtgtgtaaacagctaagttttaggcagctgttgtgccgtccagggtggaaagcagcctgttgatgtggaactgcttggctcagatttcttgggcaaacagatgccgtgtctctcaactcaccaattaagaagcccagaaaatgtggcttggagaccacatgtctggttatgtctagtaattcagatggcttcacctgggaagccctttctgaatgtcaaagccatgagataaaggacatatatatagtagctagggtggtccacttcttaggggccatctccggaggtggtgagcactaagtgccaggaagagaggaaactctgttttggagccaaagcataaaaaaaccttagccacaaaccactgaacatttgttttgtgcaggttctgagtccagggagggcttctgaggagaggggcagctggagctggtaggagttatgtgagatggagcaagggccctttaagaggtgggagcagcatgagcaaaggcagagaggtggtaatgtataaggtatgtcatgggaaagagtttggctggaacagagtttacagaatagaaaaattcaacactattaattgagcctctactacgtgctcgacattgttctagtcactgagataggtttggtatacaaaacaaaatccatcctctatggacattttagtgactaacaacaatataaataataaaagtgaacaaaagctcaaaacatgccaggcactattatttatttatttatttatttatttatttattttttgaaacagagtctcgctctgttgcccaggctggagtgtagtggtgcgatctcggctcactg

SEQ ID NO: 51 - DNA, 2289 bp, Artificial Sequence
  sequence of STAR51
tcacaggtgacaccaatcccctgaccacgctttgagaagcactgtactagattgactttctaatgtcagtcttcattttctagctctgttacagccatggtctccatattatctagtacaacacacatacaaatatgtgtgatacagtatgaatataatataaaaatatgtgttataatataaatataatattaaaatatgtctttatactagataataatacttaataacgttgagtgtttaactgctctaagcactttacctgcaggaaacagttttttttttattttggtgaaatacaactaacataaatttatttacaattttaagcatttttaagtgtatagtttagtggagttaatatattcaaaatgttgtgcagccgtcaccatcatcagtcttcataactcttttcatattgtaaaattaaaagtttatgctcatttaaaaatgactcccaatttcccccctcctcaacctctggaaactaccattctattttctgcctccgtagttttgcccactctaagtacctcacataagtggaatttgtcttatttgcctgtttgtgaccggctgatttcatttagtataatgtcctcaagttttattcacgttatatagcatatgtcataattttcttcacttttaagcttgagtaatatttcatcgtatgtatctcacattttgcttatccattcatctctcagtggacacttgagttgcttctacattttagctgttgtgaatactgctgctatgaacatgggtgtataaatatctcaagacctttttatcagttttttaaaatatatactcagtagtagtttagctggattatatggtaattttatttttaatttttgaggaactgtcctacccttttattcaatagtagctataccaattgacaattggcattcctaccaacagggcataagggttctcaattctccacatattccctgatacttgttattttcaggtgttttttttttttttttttttttatgggagccatgttaatgggtgtaaggtgatatttcattatagttttgatttgcatttccctaatgattagtgatgttaagcatctcttcatgtgcctattggccatttgtatatcttctttaaaaatatatatatactcattcctttgcccatttttgaattatgtttattttttgttattgagtttcaatacttttctatataacctaggtattaatcctttatcagacttaagatttgcaaatattctctttcattccacaggttgctaattctctctgttggtaatatcttttgatgctgttgtgtccagaattgattcattcctgtgggttcttggtctcactgacttcaagaataaagctgcggaccctagtggtgagtgttacacttcttatagatggtgtttccggagtttgttccttcagatgtgtccagagtttcttccttccaatgggttcatggtcttgctgacttcaggaatgaagccgcagaccttcgcagtgaggtttacagctcttaaaggtggcgtgtccagagttgtttgttccccctggtgggttcgtggtcttgctgacttcaggaatgaagccgcagaccctcgcagtgagtgttacagctcataaaggtagtgcggacacagagtgagctgcagcaagatttactgtgaagagcaaaagaacaaagcttccacagcatagaaggacaccccagcgggttcctgctgctggctcaggtggccagttattattcccttatttgccctgcccacatcctgctgattggtccattttacagagtactgattggtccattttacagagtgctgattggtgcatttacaatcctttagctagacacagagtgctgattgctgcattcttacagagtgctgattggtgcatttacagtcctttagctagatacagaacgctgattgctgcgttttttacagagtgctgattggtgcatttacaatcctttagctagacacagtgctgattggtgggtttttacagagtgctgattggtgcgtctttacagagtgctgattggtgcatttacaatcctttagctagacacagagtgctgattggtgcgtttataatcctctagctagacagaaaagttttccaagtccccacctgaccgagaagccccactggcttcacctctcactgttatactttggacatttgtccccccaaaatctcatgttgaaatgtaacccctaatgttggaactgaggccagactggatgtggctgggccatgggga

SEQ ID NO: 52 - DNA, 1184 bp, Artificial Sequence
  sequence of STAR52
cttatgccatctggcggtgccatgtggaacttcgctgaagaagctaaatttactgaccatctgtgcctagagcgggtttctccaaggaaaggctctgtaaatctcgtccttttgaaatctaggggaaaacagcctccttcactgaggattaatttaaagaaagggggaaataggaaaattccatgcgttggaagtccatttagatttctacatgaaccatcatatatgtgcactacataattcttatttttttatttttaaaaaagggataatttatattccagtgacaagtttgggaaaggccaaggcaagcaattgagttgaacattatgtagcgtttatatagaccttgcagacgtctgtgcaatatccaccactgaacacgtgaggtcgtactcaagtctctctggcccctggtaatgtgactcccttcctttatttgcatgaatcgcctggattgggtgtcaggtttttaaaacgtcaaggtttacgcctattgttgtcaaccaatcagcatcctactttgacgtgattggcttctactgtaggtgtcaatcatccaaaatttgcatactactcctcaggccgccgggagcctgtcagtcggctgtggcagctggaagagaaggaatcggacggagaagaatgaaaaatcactttgctttcgcaaagcgaaagaaaagtattcttttcctcattatttttaaataaatttgattgtatatttacctaataaaataaacattcaattaaacaaaaataagcaactatcaaagatttgtttactaattttcgtaatgtttactgtttcaataagtagccaaaggaatattaaaacacaaaaatatgaatgctgataattttatgtcataaagaccattttaaaactaaaagtgaacatggggtttctaaataaaattaccgtggtagcgtaaaaacactgctttcaatacttgggcatgctgaaagtgctgcatcctaagataaaaaatacaccaagggggggatttcaaagaacattattttgcttttaataatcctgtatttctgtcactttgccctttttatttatttaccgtgaactcacagacagaatattacttggagtttctgaaatacttgtgtttgtacatttctcatcttacacgtacccacacaccccaaaataaaaaaacaaagaagag

SEQ ID NO: 53 - DNA, 1431 bp, Artificial Sequence
  sequence of STAR53
ccctgaggaagatgacgagtaactccgtaagagaaccttccactcatcccccacatccctgcagacgtgctattctgttatgatactggtatcccatctgtcacttgctccccaaatcattcccttcttacaattttctactgtacagcattgaggctgaacgatgagagatttcccatgctctttctactccctgccctgtatatatccggggatcctccctacccaggatgctgtggggtcccaaaccccaagtaagccctgatatgcgggccacacctttctctagcctaggaattgataacccaggcgaggaagtcactgtggcatgaacagatggttcacttcgaggaaccgtggaaggcgtgtgcaggtcctgagatagggcagaatcggagtgtgcagggtctgcaggtcaggaggagttgagattgcgttgccacgtggtgggaactcactgccacttatttccttctctcttcttgcctcagcctcagggatacgacacatgcccatgatgagaagcagaacgtggtgacctttcacgaacatgggcatggctgcggacccctcgtcatcaggtgcatagcaagtgaaagcaagtgttcacaacagtgaaaagttgagcgtcatttttcttagtgtgccaagagttcgatgttagcgtttacgttgtattttcttacactgtgtcattctgttagatactaacattttcattgatgagcaagacatacttaatgcatattttggtttgtgtatccatgcacctaccttagaaaacaagtattgtcggttacctctgcatggaacagcattaccctcctctctccccagatgtgactactgagggcagttctgagtgtttaatttcagattttttcctctgcatttacacacacacgcacacaaaccacaccacacacacacacacacacacacacacacacacacacacacacacaccaagtaccagtataagcatctgccatctgcttttcccattgccatgcgtcctggtcaagctcccctcactctgtttcctggtcagcatgtactcccctcatccgattcccctgtagcagtcactgacagttaataaacctttgcaaacgttccccagttgtttgctcgtgccattattgtgcacacagctctgtgcacgtgtgtgcatatttctttaggaaagattcttagaagtggaattgctgtgtcaaaggagtcatttattcaacaaaacactaatgagtgcgtcctcgtgctgagcgctgttctaggtgctggagcgacgtcagggaacaaggcagacaggagttcctgacccccgttctagaggaggatgtttccagttgttgggttttgtttgtttgtttcttctagagatggtggtcttgctctgtccaggctagagtgcagtggcatgatcatagc

SEQ ID NO: 54 - DNA, 975 bp, Artificial Sequence
  sequence of STAR54
ccataaaagtgtttctaaactgcagaaaaatccccctacagtcttacagttcaagaattttcagcatgaaatgcctggtagattacctgactttttttgccaaaaataaggcacagcagctctctcctgactctgactttctatagtccttactgaattatagtccttactgaattcattcttcagtgttgcagtctgaaggacacccacattttctctttgtctttgtcaattctttgtgttgtaagggcaggatgtttaaaagttgaagtcattgacttgcaaaatgagaaatttcagagggcattttgttctctagaccatgtagcttagagcagtgttcacactgaggttgctgctaatgtttctgcagttcttaccaatagtatcatttacccagcaacaggatatgatagaggacttcgaaaaccccagaaaatgttttgccatatatccaaagccctttgggaaatggaaaggaattgcgggctcccatttttatatatggatagatagagaccaagaaagaccaaggcaactccatgtgctttacattaataaagtacaaaatgttaacatgtaggaagtctaggcgaagtttatgtgagaattctttacactaattttgcaacattttaatgcaagtctgaaattatgtcaaaataagtaaaaatttttacaagttaagcagagaataacaatgattagtcagagaaataagtagcaaaatcttcttctcagtattgacttggttgcttttcaatctctgaggacacagcagtcttcgcttccaaatccacaagtcacatcagtgaggagactcagctgagactttggctaatgttggggggtccctcctgtgtctccccaggcgcagtgagcctgcaggccgacctcactcgtggcacacaactaaatctggggagaagcaacccgatgccagcatgatgcagatatctcagggtatgatcggcc

SEQ ID NO: 55 - DNA, 501 bp, Artificial Sequence
  sequence of STAR55
cctgaactcatgatccgcccacctcagcctcctgaagtgctgggattacaggtgtgagccaccacacccagccgcaacacactcttgagcaaccaatgtgtcataaaagaaataaaatggaaatcagaaagtatcttgagacagacaaaaatggaaacacaacataccaaaatttatgggacacagcaaaagcagttttaggagggaagtttatagtgatgaatacctacctcaaaatcattagcctgattggatgacactacagtgtataaatgaattgaaaaccacattgtgccccatacatatatacaatttttatttgttaattaaaaataaaataaaactttaaaaaagaagaaagagctcaaataaacaacctaactttatacctcaaggaaatagaagagccagctaagcccaaagttgacagaaggaaaaaaatattggcagaaagaaatgaaacagagactagaaagacaattgaagagatcagcaaaacta

SEQ ID NO: 56 - DNA, 741 bp, Artificial Sequence
  sequence of STAR56
acacaggaaaagatcgcaattgttcagcagagctttgaaccggggatgacggtctccctcgttgcccggcaacatggtgtagcagccagccagttatttctctggcgtaagcaataccaggaaggaagtcttactgctgtcgccgccggagaacaggttgttcctgcctctgaacttgctgccgccatgaagcagattaaagaactccagcgcctgctcggcaagaaaacgatggaaaatgaactcctcaaagaagccgttgaatatggacgggcaaaaaagtggatagcgcacgcgcccttattgcccggggatggggagtaagcttagtcagccgttgtctccgggtgtcgcgtgcgcagttgcacgtcattctcagacgaaccgatgactggatggatggccgccgcagtcgtcacactgatgatacggatgtgcttctccgtatacaccatgttatcggagagctgccaacgtatggttatcgtcgggtatgggcgctgcttcgcagacaggcagaacttgatggtatgcctgcgatcaatgccaaacgtgtttaccggatcatgcgccagaatgcgctgttgcttgagcgaaaacctgctgtaccgccatcgaaacgggcacatacaggcagagtggccgtgaaagaaagcaatcagcgatggtgctctgacgggttcgagttctgctgtgataacggagagagactgcgtgtcacgttcgcgctggactgctgtg

SEQ ID NO: 57 - DNA, 1365 bp, Artificial Sequence
  sequence of STAR57
tccttctgtaaataggcaaaatgtattttagtttccaccacacatgttcttttctgtagggcttgtatgttggaaattttatccaattattcaattaacactataccaacaatctgctaattctggagatgtggcagtgaataaaaaagttatagtttctgattttgtggagcttggactttaatgatggacaaaacaacacattcttaaatatatatttcatcaaaattatagtgggtgaattatttatatgtgcatttacatgtgtatgtatacataaatgggcggttactggctgcactgagaatgtacacgtggcgcgaacgaggctgggcggtcagagaaggcctcccaaggaggtggctttgaagctgagtggtgcttccacgtgaaaaggctggaaagggcattccaagaaaaggctgaggccagcgggaaagaggttccagtgcgctctgggaacggaaagcgcacctgcctgaaacgaaaatgagtgtgctgaaataggacgctagaaagggaggcagaggctggcaaaagcgaccgaggaggagctcaaaggagcgagcggggaaggccgctgtggagcctggaggaagcacttcggaagcgcttctgagcgggtaaggccgctgggagcatgaactgctgagcaggtgtgtccagaattcgtgggttcttggtctcactgacttcaagaatgaagagggaccgcggaccctcgcggtgagtgttacagctcttaaggtggcgcgtctggagtttgttccttctgatgttcggatgtgttcagagtttcttccttctggtgggttcgtggtctcgctggctcaggagtgaagctgcagaccttcgcggtgagtgttacagctcataaaagcagggtggactcaaagagtgagcagcagcaagatttattgcaaagaatgaaagaacaaagcttccacactgtggaaggggaccccagcgggttgccactgctggctccgcagcctgcttttattctcttatctggccccacccacatcctgctgattggtagagccgaatggtctgttttgacggcgctgattggtgcgtttacaatccctgcgctagatacaaaggttctccacgtccccaccagattagctagatagagtctccacacaaaggttctccaaggccccaccagagtagctagatacagagtgttgattggtgcattcacaaaccctgagctagacacagggtgatgactggtgtgtttacaaaccttgcggtagatacagagtatcaattggcgtatttacaatcactgagctaggcataaaggttctccaggtccccaccagactcaggagcccagctggcttcacccagtgg

SEQ ID NO: 58 - DNA, 1401 bp, Artificial Sequence
  sequence of STAR58
aagtttaccttagccctaaattatttcattgtgattggcattttaggaaatatgtattaaggaatgtctcttaggagataaggataacatatgtctaagaaaattatattgaaatattattacatgaactaaaatgttagaactgaaaaaaaattattgtaactccttccagcgtaggcaggagtatctagataccaactttaacaactcaactttaacaacttcgaaccaaccagatggctaggagattcacctatttagcatgatatcttttattgataaaaaaatataaaacttccattaaatttttaagctactacaatcctattaaattttaacttaccagtgttctcaatgctacataatttaaaatcattgaaatcttctgattttaactcctcagtcttgaaatctacttatttttagttacatatatatccaatctactgccgctagtagaagaagcttggaatttgagaaaaaaatcagacgttttgtatattctcatattcactaatttattttttaaatgagtttctgcaatgcatcaagcagtggcaaaacaggagaaaaattaaaattggttgaaaagatatgtgtgccaaacaatcccttgaaatttgatgaagtgactaatcctgagttattgtttcaaatgtgtacctgtttatacaagggtatcacctttgaaatctcaacattaaatgaaattttataagcaatttgttgtaacatgattattataaaattctgatataacattttttattacctgtttagagtttaaagagagaaaaggagttaagaataattacattttcattagcattgtccgggtgcaaaaacttctaacactatcttcaaatctttttctccattgccttctgaacatacccacttgggtatctcattagcactgcaaattcaacattttcgattgctaatttttctccctaaatatttatttgttttctcagctttagccaatgtttcactattgaccatttgctcaagtatagtgacgcttcaatgaccttcagagagctgtttcagtccttcctggactacttgcatgcttccaacaaaatgaagcactcttgatgtcagtcactcaaataaatggaaatgggcccatttactaggaatgttaacagaataaaaagatagacgtgacaccagttgcttcagtccatctccatttacttgcttaaggcctggccatatttctcacagttgatatggcgcagggcacatgtttaaatggctgttcttgtaggatggtttgactgttggattcctcatcttccctctccttaggaaggaaggttacagtagtactgttggctcctggaatatagattcataaagaactaatggagtatcatctcccactgctcttgt

SEQ ID NO: 59 - DNA, 866 bp, Artificial Sequence
  sequence of STAR59
gagatcacgccactgcactccagcctgggggacagagcaagactccatctcagaaacaaacaaacacacaaagccagtcaaggtgtttaattcgacggtgtcaggctcaggtctcttgacaggatacatccagcacccgggggaaacgtcgatgggtggggtggaatctattttgtggcctcaagggagggtttgagaggtagtcccgcaagcggtgatggcctaaggaagcccctccgcccaagaagcgatattcatttctagcctgtagccacccaagagggagaatcgggctcgccacagaccccacaacccccaacccaccccacccccacccctcccacctcgtgaaatgggctctcgctccgtcaggctctagtcacaccgtgtggttttggaacctccagcgtgtgtgcgtgggttgcgtggtggggtggggccggctgtggacagaggaggggataaagcggcggtgtcccgcgggtgcccgggacgtggggcgtggggcgtgggtggggtggccagagccttgggaactcgtcgcctgtcgggacgtctcccctcctggtcccctctctgacctacgctccacatcttcgccgttcagtggggaccttgtgggtggaagtcaccatccctttggactttagccgacgaaggccgggctcccaagagtctccccggaggcggggccttgggcaggctcacaaggatgctgacggtgacggttggtgacggtgatgtacttcggaggcctcgggccaatgcagaggtatccatttgacctcggtgggacaggtcagctttgcggagtcccgtgcgtccttccagagactcatccagcgctagcaagcatggtcccgagg

SEQ ID NO: 60 - DNA, 2067 bp, Artificial Sequence
  sequence of STAR60
  misc_feature (92)..(1777): All "N" on various positions stand for any nucleotide
agcagtgcagaactggggaagaagaagagtccctacaccacttaatactcaaaagtactcgcaaaaaataacacccctcaccaggtggcatnattactctccttcattgagaaaattaggaaactggacttcgtagaagctaattgctttatccagagccacctgcatacaaacctgcagcgccacctgcatacaaacctgtcagccgaccccaaagccctcagtcgcaccaagcctctgctgcacaccctcgtgccttcacactggccgttccccaagcctggggcatactncccagctctgagaaatgtattcatccttcaaagccctgctcatgtgtcctnntcaacaggaaaatctcccatgagatgctctgctatccccatctctcctgccccatagcttaggcanacttctgtggtggtgagtcctgggctgtgctgtgatgtgttcgcctgcnatgtntgttcttccccacaatgatgggcccctgaattctctatctctagcacctgtgctcagtaaaggcttgggaaaccaggctcaaagcctggcccagatgccaccttttccagggtgcttccgggggccaccaaccagagtgcagccttctcctccaccaggaactcttgcagccccacccctgagcacctgcaccccattacccatctttgtttctccgtgtgatcgtattattacagaattatatactgtattcttaatacagtatataattgtataattattcttaatacagtatataattatacaaatacaaaatatgtgttaatggaccgtttatgttactggtaaagctttaagtcaacagtgggacattagttaggtttttggcgaagtcaaaagttatatgtgcattttcaacttcttgaggggtcggtacntctnacccccatgttgttcaanggtcaactgtctacacatatcatagctaattcactacagaaatgttagcttgtgtcactagtatctccccttctcataagcttaatacacataccttgagagagctcttggccatctctactaatgactgaagtttttatttattatagatgtcataataggcataaaactacattacatcattcgagtgccaattttgccaccttgaccctcttttgcaaaacaccaacgtcagtacacatatgaagaggaaactgcccgagaactgaagttcctgagaccaggagctgcaggcgttagatagaatatggtgacgagagttacgaggatgacgagagtaaatacttcatactcagtacgtgccaagcactgctataagcgctctgtatgtgtgaagtcatttaatcctcacagcatcccacggtgtaattattttcattatccccatgagggaacagaaactcagaacggttcaacacatatgcgagaagtcgcagccggtcagtgagagagcaggttcccgtccaagcagtcagaccccgagtgcacactctcgacccctgtccagcagactcactcgtcataaggcggggagtgntctgtttcagccagatgctttatgcatctcagagtacccaaaccatgaaagaatgaggcagtattcangagcagatggngctgggcagtaaggctgggcttcagaatagctggaaagctcaagtnatgggacctgcaagaaaaatccattgtttngataaatagccaaagtccctaggctgtaaggggaaggtgtgccaggtgcaagtggagctctaatgtaaaatcgcacctgagtctcctggtcttatgagtnctgggtgtaccccagtgaaaggtcctgctgccaccaagtgggccatggttcagctgtgtaagtgctgagcggcagccggaccgcttcctctaacttcacctccaaaggcacagtgcacctggttcctccagcactcagctgcgaggcccctagccagggtcccggcccccggcccccggcagctgctccagcttccttccccacagcattcaggatggtctgcgttcatgtagacctttgttttcagtctgtgctccgaggtcactggcagcactagccccggctcctgt

SEQ ID NO: 61 - DNA, 1470 bp, Artificial Sequence
  sequence of STAR61
  misc_feature (130)..(976): "N" stands for any nucleotide on various positions
cagcccccacatgcccagccctgtgctcagctctgcagcggggcatggtgggcagagacacagaggccaaggccctgcttcggggacggtgggcctgggatgagcatggccttggccttcgccgagagtnctcttgtgaaggaggggtcaggaggggctgctgcagctggggaggagggcgatggcactgtggcangaagtgaantagtgtgggtgcctngcaccccaggcacggccagcctggggtatggacccggggccntctgttctagagcaggaaggtatggtgaggacctcaaaaggacagccactggagagctccaggcagaggnacttgagaggccctggggccatcctgtctcttttctgggtctgtgtgctctgggcctgggcccttcctctgctcccccgggcttggagagggctggccttgcctcgtgcaaaggaccactctagactggtaccaagtctggcccatggcctcctgtgggtgcaggcctgtgcgggtgacctgagagccagggctggcaggtcagagtcaggagagggatggcagtggatgccctgtgcaggatctgcctaatcatggtgaggctggaggaatccaaagtgggcatgcactctgcactcatttctttattcatgtgtgcccatcccaacaagcagggagcctggccaggagggcccctgggagaaggcactgatgggctgtgttccatttaggaaggatggacggttgtgagacgggtaagtcagaacgggctgcccacctcggccgagagggccccgtggtgggttggcaccatctgggcctggagagctgctcaggaggctctctagggctgggtgaccaggnctggggtacagtagccatgggagcaggtgcttacctggggctgtccctgagcaggggctgcattgggtgctctgtgagcacacacttctctattcacctgagtcccnctgagtgatgagnacacccttgttttgcagatgaatctgagcatggagatgttaagtggcttgcctgagccacacagcagatggatggtgtagctgggacctgagggcaggcagtcccagcccgaggacttcccaaggttgtggcaaactctgacagcatgaccccagggaacacccatctcagctctggtcagacactgcggagttgtgttgtaacccacacagctggagacagccaccctagccccacccttatcctctcccaaaggaacctgccctttcccttcattttcctcttactgcattgagggaccacacagtgtggcagaaggaacatgggttcaggacccagatggacttgcttcacagtgcagccctcctgtcctcttgcagagtgcgtcttccactgtgaagttgggacagtcacaccaactcaatactgctgggcccgtcacacggtgggcaggcaacggatggcagtcactggctgtgggtctgcagaggtgg

SEQ ID NO: 62 - DNA, 1011 bp, Artificial Sequence
  sequence of STAR62
agtgtcaaatagatctacacaaaacaagataatgtctgcccatttttccaaagataatgtggtgaagtgggtagagagaaatgcatccattctccccacccaacctctgctaaattgtccatgtcacagtactgagaccagggggcttattcccagcgggcagaatgtgcaccaagcacctcttgtctcaatttgcagtctaggccctgctatttgatggtgtgaaggcttgcacctggcatggaaggtccgttttgtacttcttgctttagcagttcaaagagcagggagagctgcgagggcctctgcagcttcagatggatgtggtcagcttgttggaggcgccttctgtggtccattatctccagcccccctgcggtgttgctgtttgcttggcttgtctggctctccatgccttgttggctccaaaatgtcatcatgctgcaccccaggaagaatgtgcaggcccatctcttttatgtgctttgggctattttgattccccgttgggtatattccctaggtaagacccagaagacacaggaggtagttgctttgggagagtttggacctatgggtatgaggtaatagacacagtatcttctctttcatttggtgagactgttagctctggccgcggactgaattccacacagctcacttgggaaaactttattccaaaacatagtcacattgaacattgtggagaatgagggacagagaagaggccctagatttgtacatctgggtgttatgtctataaatagaatgctttggtggtcaactagacttgttcatgttgacatttagtcttgccttttcggtggtgatttaaaaattatgtatatcttgtttggaatatagtggagctatggtgtggcattttcatctggctttttgtttagctcagcccgtcctgttatgggcagccttgaagctcagtagctaatgaagaggtatcctcactccctccagagagcggtcccctcacggctcattgagagtttgtca

SEQ ID NO: 63 - DNA, 1410 bp, Artificial Sequence
  sequence of STAR63
gcgtctgagccgctgggaacccatgagccccgtccatggagttgaggaagggggttcgccccacggggtgggcgccctctacacagcgcgcttcctcttctctcgttagcgccgcgggaccagcctctggttctgcacctcgcgctctgggagcagcgcccggctttggcgagcgcttccccggggctgcccagcctctgctccgctcgccccgccaggcccggctccgcgaagcccccagggtccagtccaaggccccgattccccaaggccagggccccggggcagcattggaacagggcgcggacgccagtcctccgagcatggagtaactgcagcttttgagaaaagaaagcggaccccaccccatcgagaacgcggcgccttgtttagggacgttcctgggccgtcacggagtgtcgccggctcctcggcccctccctcctccaagcccccacccccgacagcggcctccctggggacctcccctcgggctgcgctttcagcccaaacacagggaggtcttccaggagcctgcccagtccccacagcagcccagagacccccactcccacctgtacctgccaagccttcagagagggcggcctggacatgccccgcacgggaggagccccgcctcagcacccctgcaagtggcagcaacccagaacacccgtgagaggcctctgagcagcccaggaagtggctggaagacgcataggcagctcactcctctgtaagagcaaggaccggagaacacatgctgacccctgcttttgcagaggggcgatgcttcaggacaggcgcgctcagcaggtgtccatcttatttcacacctttgtgtttatatcatcttattttgcattttatgtctaattaacaatatgcagctggccaggcgcagtggctcaagcctctaatcccagcactttgggaggccgaggcaggtgtatcacttgagggcaggagttcgggaccggcctgggcaacatagcaaaaccccattgctaataaaaatacaaaaattagccagccatggtggcgggcacctgcagtcccagctactccggaagctgaagcaggagaatcacttgaacccaggaggcggaggtggcagtgagctatcaagccattacactccagcctgggcaacagagaaagactgtctcaaaaaaaaattaatacgcagcagaatattatgtggtcagcccaagcagtcccccccactcagccctctgtccctacagctccaggcactcccccagcccctcccctggacaagaggtaatgcccagagggtgaaaatccaccaaggttaagccagaaacaaaaagctcaaagcttcggcatctccctccgctcagacccttagagcagattcctctcatcgacagcacgatcaggctgtgg

SEQ ID NO: 64 - DNA, 1414 bp, Artificial Sequence
  sequence of STAR64
agagatcttttaagggctcaaaagaccctgcggctcccctgccaatagctctgccatcgtccccagagctttcgaggaccctccaccatcggcgccaaccccagctgagctgggtgctcgtctgcaggcctctgctccatctcagcctgagcatgaggctctgctgtgctgcttccagcagcagggacagggctgatgagcctggcccttgcaagcatcttcctgtgccgaatacaattccacagacagaggatttaaaatccaagtggaggtgacaggaaagaaaggaaaacctccaggtatcagaagaaaggagggggtgtgaagacagtatgggaggaaggtcaggctggggctcagctctgggaagtgccagcctgaacaggagtcacgcccgggtccacatgcaagggaatgaggaccgaggccctgcatgtggcagggccttccgcaggctgccccgtctgtgaacaggacaccagaagaagtctgccttccagcctggcaaagtggcaaggaacctctgggtgggaaaacaaatcaacaaacaaattgtcagtaaaaaacagaaacctcacactttcctttctcttgacctcttgaaaaaagcaaatccactgcagctcaccaaaggcaaagagaaaaccttaagaatacccagagagaaaagacacgttacttgcaaaagaacatctaatgcagggagataatgaaaatacagactcttcaaagggctgaaggaaaaaaaccgtccacctagaattctatccccaaactgtcatctgagagcaagggcaaaacaaacgctttctcagacaggctggacgaggtcgctcacgcctgtaatcctagcactttgggaggccaaggtgggaggaccgctttaagccagaagtttgagaccagtgtgggtaacataatgagaccccatctctaagaaaaagaaattaaataagacaagactttttcagacaacaagtgctctgagagctggcctatcttggctgtcttgtaaagaattgctgcgagacacctcattaggaaagagactgaatctagaaggaaagagcagagcatgaggtacaatgaggagcaaataaacaggtcaccatataagcaaacccaaatacacattcactatacgaaacaataaaaatgactcatttggggggttaaaacactgttgaactaaaatcctggataacagcagcatgaaaggtggggtggtggtcccaggaaagcattcaaaggtccatgtctcatttgggaggagggtagggagactcatgaacttgaggctcccttcaggcaagcacagtgcaaaaaaattataataatgggaaacagatacagtagactgtgatgtacaactctcagagcagtagaagggagggtataaaacaaatctgatcca

SEQ ID NO: 65 - DNA, 1310 bp, Artificial Sequence
  sequence of STAR65
tcgagaccagcctggccaacatggtgaaacattgtctctattacaaatacaaaaattagccaggtgtagtggtgcatgcctgcagtcccagccatttgggaggctgaagttggagaatcgcttaaacctgggaggtggaggttgcattgagccgagaagcactccagcctggatgacggagcaagactgtctcaaaaagaaaaaaaaaagaagcagcagcaaatatccctgtcctgatggaggctatataacaaccaaacaagtgaatgcataagacaatttcaaggttatggtagataccataagtgggagatgaacaatgagaacacatggacacagggaggagaacatcacacactggggcctctcggggggtggggaaatagggggtgatagcattaggagaaatacctaatgtcgataacaggttagtgggtgcagcaaaccaccatggcacgtgtatatctatgtaacacacctgcacgttctgcacatgtatcccagaacttaaagtataataaaaaaagacattaaaaaattatgatataaaatcccaattcaagttgttttaaaaagagaaaacaattatctttatataatagcggaaaatatagatggcggaattaaagcctcgtcatattttctaacagaactttctgataaacttgattaaataaaaattttaaatatcactaaacacatagaagaaataaatttaaaccttcacaaaaaataaagtacaatgaatgaagacaaggtgtacttgaaaaaagaactgaataaatattctacatataaaaaaaatctgatgatattgtggtgattctttactttgctactagtttctctttttttcttctgaaaaatttcttgggatgtatttggtttcattagtaaaattctaagtttctttgcaatctgaacattggagcttcatccatagccagtatgccctaacattatctttggacaactgtaaaattagaacactgccagacatatttaatgtatgatgtatatcaacactgggacacattttatactatctttattccaaaatcaaatgattcactgtggtttataaatgtacatggatatatctctacctaagcagatagttaggagagttagtaaaaatgaggtggaaaataggagtcactgtcccttcacagggagagaattctgcttttctcctaatataccctttgcttgaacagactccaacccctcatcttttgtcctttaaatgaccacatttattttaactttgataaacaacacagaaagatatttgatccatcaacattcac

SEQ ID NO: 66 - DNA, 2500 bp, Artificial Sequence
  sequence of T2F (STAR66F)
gcaggttggatggtgctgacccctcctcgggttggcttcctgtctccaggtggacgtcctgtactccagggtctgcaagcctaaaaggagggacccaggacccaccacagacccgctggaccccaagggccagggagcgattctggccctggcgggtgacctggcctaccagaccctcccgctcagggccctggatgtggacagcggccccctggaaaacgtgtatgagagcatccgggagctgggggaccctgctggcaggagcagcacgtgcggggctgggacgccccctgcttccagctgccccagcctagggaggggctggagacccctccctgcctccctgccctgaacactcaaggacctgtgctccttcctccagagtgaggcccgtcccccgccccgccccgcctcacagctgacagcgccagtcccaggtccccgggctgccagcccgtgaggtccgtgaggtcctggccgctctgacagccgcggcctccccgggctccagagaaggcccgcgtctaaataaagcgccagcgcaggatgaaagcggccagcctcgcagcctgctcttcttgaaagctgggcgggttggggcggggggcttctctggaaggcttggagctgtcccctctggccttgggggactggctgcccccggggcgcccgggcctagccgaggcggtgctcctgccggccagactctcggtcagtgcgggcacggggtcccagccactcctagggggcagcgcagccggcagggtggccgcccccgggtgggacttggaccctggactccacgggagggctccgccacccagcctggtgttacataaggggtggtggaggtgggcagtcgagcgttaaagagtaacctgctgccgggaagcccgccaagcaatcgcggccccttccccggctctggcagctctgcgagcgcgcccgtggggaacgggccctccccggcggggcgcgcgggcgcgcgaggtgggcggaggcctcggagctgtgccgggccgggcctccctccctaggccagcgcgggagcgacccggagggggcgggcccggggcggggcctcgaagcgctggccggcgggagcgcggccggccgggcccgcccgcctgcggtgtggacgccgcgcggccaatgcgcgcgccgggacgggacgggacggggcggggcggggcgggacgagacggggcggggcggggcgggccgggcagcctccgggcggcgcggcgcgggcggcggccggatccagggcgggggtcggcggcccggccagcccggcccggcccggggccgcgtcctgagagtcagccctcgccgctgcagcctcggcgcccggccggccggccatggagcgccccccgccccgcgccgccggccgggaccccagtgcgctgcgggccgaggcgccgtggctgcgcgcggagggtccggggccgcgcgccgcgcccgtgacggtgcccacgccgccgcaggtaccgggcgccggtgggcgggggcgccgaccaagtttctctcgctgcaaagatggcgtcagtgctgcccaaacttcgggcccccgggggcggggcagcggggagggcggccgcgtcggtccgcgcgtgtccgtgggtcccgccggggctgcgccgggcggccggggagcccttcccgccgcgccgggctgggggcggggccgggggcggggccgcgccgtccacaccggccgcagccggttttcgaggcgggcgccgagcggatccgcggcggaggttgagggacccccctcccccggccaccgcctccgctgagtctgccccctccccatccgcagggctcttccgtgggcggcggcttcgcgggcttggagttcgcgcggccgcaggagtcggagccgcgggcctcggacctgggggccccccggacgtggacgggggcggcggcggggccccggactccgtcggcgcacatccccgtcccagcgcagaggtgagcgggaggcccggtgcctcgggactcggtgtgcgcaggggcggtgggtggggtgcggagacaccggccccgacggaggccaggtcagggccccaggtttgtaattaccagccacccccaagctcttcagccctggaggagctgagcagaaatgatcgatgactgggagtccctacacctccctccaccgcagttcctcggggctagagctcagaacccggagcgggtggctgtgcgtctctgtgcagaagaggctgcgcggtcggcatggggcgactgtccaggaatccctggggctcctgaccgccacctcccaacccctgccaggccggacacctcggtctggctgccagggcaggggcgggccctggcctggctcgctggggcctggggagctgcccgtgcttccagcccagtctccccctggctgctgccggctgctggccactcccacctcccaggcctggcgtgaggcccacagctgctgttgcacaaccctggttaatgtgtgatg

SEQ ID NO: 67 - DNA, 2500 bp, Artificial Sequence
  sequence of T2R (STAR66R)
gtttggggtagagagaacatactgattatgggactttgctttgcagcttagtgctgtcctgtcagtgggaagcaacagggggcagaactcagcttgtgcccatagagggaatgtttatactaggcctgtccagaggcaaatcatccatcctagcaattggaacctgacttttggcaagtcctgccaccatgggctaaagtgttctggggttctaaataaacatgaaaggcaacctagaccacaaggactgcaattcctgcacaagtcctggtgctgtgttgggcttggagccagggaacttggagtgcatggaacctagtgagataccagctgagacaaccaaggaagtgcttgtgtcacccctccaccaaccccaggcagtacagattgtacctccaagaccccttccatctgcttgaggaaggtggaggggaagaggactttgttttgcaacttggattccagcccatccacagtagaataaggcaacgggcagactcctaaggcccccatcccagaccctagctcctggatgacatttctaaacacaccatgggccagaagggaacccattgccttgaagggaagggcccagtcctggcagaatttatcatgtgctgaataaacagcccttgggccctgaataattagtattggtagccaggcagtatttaccacaggccttgggtgagacccagagccatgttggcttcaggtgtgacccagcacattcccagctgtggtaactttggggagagaccacttctgcttgagaaaaggagacagaagagtaaaggggtctttatcttgcagcctggtaccagcttggccgcagtggggtagagcaccaagagagcacctgggataaacaaaatcaaaaaacctttagctagactaagagtaaagagagaagacccaagtaaatataatcaaagacaaaaaaggagagacattacaaccaatacctcagaaattcaaagtatcattagcagctactttgaacaactatatgccagtaaattggaaaacctagaagaattatataaattcctaacatatacaacctaccaagattgaaccatgaagaaatttaaagcctgaataggccaataacaagcaatgagattggagccctaatacaaagtttacaatgagaaacattgctcaaacaaatcatagatgacacaaacaaatggaaaacatccaatgctcatggacaggaaaaaatatttaaatttctatactgcccaaagcagtttatacattcaatgctattcctgtcaaaataccaatcttattcttcacaaaaaaaaaattaaaaattacacagaaccaaaaaagagcccaaatacccaaggcaattttaagcaaaaagaacaaagctggaggcatcacgttacctgtgatccacactatagggctacagtaaatgaaacagcaaggtgctggtatacaaacagacacataaaccaatggaatagaataaagagcttagaaataatgctccacacctccagccatccgatgtttgagaaagtagacataaacaagcaatgaggagaggactccctattcattaaatcaactcaagacggaccaaaaacctaaatgtaaaacaaacaaacaaaaaaaataactgctaaaaccctgggagatgacctaggaaataccattctggacagtacctggtgaaaatttcatgctgaagacaccaaaaacaattgcagcaaaagaaaaaattgacatatgggatcaaattaaactttagagcttttgcacagcaaaataaactatcaacagagtaaataggcaccctacaggaagggagaaaatattttcaatctgtgctctgacaaagtcctaatatccagagcctataaggaacttaaacaaatttacaaacaaaaaacaaacaacactattacgagttggaaaaggacatgaatcgacacttttcaaaagaagacatacatgtggctaacaagcatatgaaaaaaatgctcaacattactaatcattagagaaatgcaaatcaaaaccacaatgagataccatctcaaccagtctgaatggctgttattaaaaaaatcagaaaaaaacagatgctggcaaggttgtggagaaaaggaaacacttatacattgttggggggagtgtaaattaattcagccattgtggaaagtattgtggtgattttctaaagaactaaaaaggaattactattttacctggaaatttcattattgggtatatacccaaagaaatatgaattattttactataaagacagatgcatgcatgtgttcattgtagcactattcacagtagcaaagacatgttatcaacctaaatgcccattaacagtaaactggataaggaaaatatggtacatatacactgtggaatactatgcagtcataaaaagaatgagataatgttcattgcagcaacatggatggaactggagaccattatccttgggaaactaacaaagcaacag

SEQ ID NO: 68 - DNA, 2501 bp, Artificial Sequence
  sequence of T3F
agatttgccctcaagattacaactgctggggctaaagtggtacagagcctgagttcagtaggcttccatagtctcactcaagaatgcaagtttacctctcaatctttcaatcatcacaattataacaactttaaaaagagccaacatgatatttgcttatcacttttctactcacattccagtattaactcaaaagtgtcaacacaaccttcgtgataaatactattaacgtcatcattcctactgtacagatgatgatagtgacacataggttaagttgcccaaggtcttattattaagggtcatagccaggatttgatctcttcagtaaagttctagtcaatgctcttaaccattaagccatgcaacacacccagagccaactgggttgtgttgatgattataatatttgttttaacaaacaataatttttcctaaatataatatagattttccataaataccataaattcttgattatttatttcactttattccaaaaggaagttgaattctgagatttaaatgaatagcaaacaacagttgcttaatttcactacttttgtcacttgtagccagtacttaaaaagagatacataatttatttttgttgatttgcatttcacatataattgtaagatcctggagaataaagactatatgtgttataccattttactctctcacacagtgtgtaggcctaggctttgtgcatagcaagtgttaaaaagtaatgtgactcgtgatagttattagatttattgaaattcagaaatttagggaaatgcacaataaaatgtacattttgtgattccggtcaaattacttaaaaattatatttttcctatgaataatttttatttcacttaaattatgtataacaaaataacatgcataattaaacatttaccacaaagaaaatatttgtactattgttatcacaataaagaacttgctacataaattcaattacacttttgtggaaagtatcttcattatataaaaacaatctacatttagaataggaaaattgtacaaaacatgaaaatataaacaaattaagcgagaattatctaaaaagcaactcttcagaatttagaagaattgtctagaataaaaagaatttagaagaattatctaagaaacaaccataaatattctgatgtatttaagactcatattctagaatcctgactattattttttatacttctatggctaatctcaagtttagctttatttttctaaagcaatgaggcctgtagaatattttttcagaattctctgaggttttttcttttttgtctttcctgtcatagtatgccaattattcatgggtttatagaatatgtatgcactgctaagagcagcaaaacaaaagatatatgtgctatttattaattcatgttgctttatttaaattacttgaaaatgataaagaaaaaactattgtatttacaacagcaaccaaatatagactacctgtaactacatctaacagaataaataaaatataacatacaatatgtagtaaatatatttataatatatatgttcactaaatagttaacctgtaacttacttacagtaaatatatataatatctactgagatagtaccacattttattaaggattaaacttttaataattcagaagaataaatataataaatttcatttgttctcaaactaatttgtttttatttgtttgttttttgtattttaatttgacagtagttccaagatattttggggtatataatgaggtgataattgcaaagaaaattctgaaaaggaaaagactaagcgtgaattgaaagtaaaattcgttaaaaggtataataaactgtgatactgtaacaataattgaaaatagataaagaaaaaggtaacatcaataaatagtctattatatatgtgaattatgttaataaaagtgacattttattttcaatccacaatttctgaaatatatatggcaatatttttctgttttattttttcaacctctgattactttattacatttttttctttttctagaatttacttgtattttctctgtgtctaatatatgattatttctgaactagcatcattggtcctggaaccagactatattattcccaaggtagagcatcaaaatataacaattaaataaatacttttagttactttaacaaccttttgtctttcattataattttggaattatagtttagtacaatacagatagttttaatatctgttagagtgaagatatatatatatgtgtgtgtgtttttgagatggagtctcactctgttgcccaggctggagtacagtggtgccatctcggctcacggcaacctctgcgtcccaggttcaagcaattctcctgcctcagcctcccgggtagctgggactacaggcgagtgtcaccacgcctggctaattttttgtatttttagtagagacagggtttcaccatattagccaggatggtctcggtctcctgact

SEQ ID NO: 69 - DNA, 2511 bp, Artificial Sequence
  sequence of T3R
cttttggtgccctgtcccttataatttcctcgtgtgtcctttcccatttgcttatccgatgacttgcttctctcacccattggattgtgagcctcttgtggtcaggggcagtgctctgtaagctgctgtgtccccagaatctggcccagtgtaggcactcagcagctatagactgatgttaagagaaaatgcacatttcatctcagcctcagagcagttctgggaaacagataggaaaccaaagctctgcaagaacgtgggactctctcagggccatcacaacactgttgttggtctcatgtttggtgactgggtctcctattcctggtctctttcctaggcataatgcttttatataaagtcccttccattgtttttttgtttgttttcttttttcagcctaaataacttagtttctctaaacttttctcccagggactcttttttaaccctttgaattattgctgattattatcttaataacttttattttttttccattttgcatgtcatattttagcaaagcattaaaaggaacacggcacaaagcacacccatatttttggatgctgtggatttcatcatgctgcttattccattatatctagtcagtacctccaaggcattaatgctgccttacctccttcattcgaagacttccctgtgcaaggtggaatatacgtaaggaggcaaacagactgggttatatgcctgctctgctttacagaggcctcttccaggagtgtaatacgggggttgctcatactctgaagaagatagtggcaggctattactgtcatgagagccagaacgtggctggcttcttacagacatggcttcataggggcatgccacgtgattcctgagtaagccttctggtgtgaattccctgctcactggggtgattcttcacttcccacagttcaacctgctgtattatcctcttacctatgcttttctgtgatccatagaggtaatttaattttcagtccatgtacctaccctgcctacttagtttcttctcagtgccacacttaattccttcacatttactgattaattaaatgagaagactatgccaggtgaaggttcagcatcttcagaactctacatgatgcattccctgaggctgcctttcaataactgaggtgatattctttgagcagtgtgacctgttagaggtgcccagtcaggtccgatgaaaagccctctgatttgttgaaatagtgcattagtaaagtattatagtttattttcacaaagctagattagttgttacatgttggtttttgttttgcctagccctaacaagtatggaggtgaccttgatgtgtctatagaatatcaggaatatctggctgggtgggtggctcacacctgtaatcccaacaatttgggaggccgaggtgggcggatcacctgaggtcaggagtttgagagaggcctggccaacatggtgaacccccgtctctactaaaaatacaaaaattagccaggtgtggtggcaggtgcctgcaatctcagctactccggaggctgatgcaggggaatcacttgaacccgggaggtagaggttgcagtgagccaagattgtgccactgcactccagcctgggcaacagagcgagattctgcctcaaaaaaaaaaaaaaaaaaaaaaaaaaaaaaagaatatcaggaatatccattttatgtctcaactcacatacctcacagttttctggtccaatttttaggcactttatcaggccctcatatgttttcaaaaataattgctaatgactttgatgaagctaggcaagatattttttggttttagggcagtttgggctatagtttgcagccttcctactttaatagaagaatttttaaactagattctcccccttctcagggtggctttctgcctttccattctagtgcttcacacagaaatgacaagctcacaggggacttatctagaaaaggccgagataaaaataagtacaatgttaaaaaaatctatcttatagtatcatttatttagagcttcctctccttttctaatgaaaggctgctgtagtttccttttgtgctttttttgctgaaggcttttcagtaatattcccgtgtgtcccctgtgatgctaaaagcatgagcttgggggcaggttgactggcattcaggtctttgctcagcctccagccgcaagacaaggcgaataatattgatctcatggagctgaaatgaaaattaacttttctaatctgtgaaaatgctttgttataatccttaaatacatgaatacataggttgaaatagcaagtaccaagtgctgacattatgtccacaattgccacatgccatgtccttatgatttttgccagatgtttaataagattataaatgaataggttattaaatgggcatctcctactctctaggtgtttctgtttctgcttctctgttttctgtttgtatctccatttattttaatgcctaccattatgtgaagtctgccaccttcctatac

SEQ ID NO: 70 - DNA, 1500 bp, Artificial Sequence
  sequence of T5F
gaactcaataggggtcttgtacggagcaggggcttggtccctcgtacctctggccatacctatggagcccaggggatgcttggcagcacctgggaggtgccaaccccgggtggcaagggagggccggtcccacgctcacattgtcttctgttctctctctctctttatctgtgtcgatgtctctctctcttcccccgtgcccgtgccatcctctccacccctggattcctgtctctgcttggctttcacccacttctcctccccacccacggctgctcctcctcctgtccccacctcctccccgggtgcaggacgggcctcttcacacctgacctcgcttttgaagccacagtgaaaaagcaggtgcagaagctcaaagagcccagtatcaagtgtgtggatatggtagtcagtgagctcacagccaccatcagaaagtgtagcgaaaaggtatgacggccgcctgggcggggctgggcctggccgtccattccttgtggccacagcctcccgtgggcagaaggatctgctgagccggcctcacggctacccgcagggacccagccctagtgtttcctgccagtttctaaccctgggtacttgcactcatgacccctccaggcccccatcccagaagacttgactccaacccaagcctccttggtggcacctatgctagtgatgaagatgatgttaaggagatggcagctgtttactgagcacctactatgtgccaagcacacgctaagtgcttgcccttactatctgactcagtcctctcaaccaccctaagacgtgggtagtgttgttattcccattttgcagatggcaaaacagagtctcagaaaagagaagcagagtgtgattcagttttaggaaggacagaggaaggggtctgaggtcagggcctcctgggcagggggagctgtcctagttcctcaaaaccaatttgcctgaaagcatattggattactcactttacagtaatccgtgcgtgagagacaggggcggtctcttttgagttgtctgtgactttttagatgcctttttcctatttgtctgcttttgggcattttgaggatttttagccaggttgtctaaagcagttcttcccaggggagtgcgagagaatcagttgcctgcaggagcttctccagcaggctaaatcagaggtgccaggggtgagcccagcctcacctatatctgaaggacttccctatgctggtgggtggaggcacatccaccttagcattgagtttcaaataagcatcaatcatctccattcctttttttttttttttttttttttgagatggaatcttgctctgtcgcccaggctggagtgcagtggcaccatcttggctcactgcaacctctgcctcctgggttcaagtattctcctgcctcagcctcccgggtggctgggattactagcatgtaccaccacacctggctaatttttgtatttttagtagagatggggttttgccacgttggcca

SEQ ID NO: 71 - DNA, 1500 bp, Artificial Sequence
  sequence of T5R
gattacaggcgtgagccaccacacctggcccagtggggtccttctaaaatgcaaagctgatcatgtctcttcttccaggcttaaagccctcccatggcttcctgcagccctggtgcacgccttacgccaagcctgaaaacactctgcacacccaccccttccctgcacaaacgggcctctgcacactacctgccccggccatgcccccgcaaccagccctctctgcttatctaccttggccttctctctggtcaagccccaggcccgtccctgcccctaggccttcacttagagcctcagaagcacttcttgcaggaagccctccagactccagaatgggtccagaacctacttccttttcgtggcatttctgtattctttttttttttcttccatagagccagggtctcactgtgtttcctaggctagtctcgaactcctgggctcaactgatcctcctgccttggccttccatagtgctgggattacaggcatgagtcattgcacccggcctccacagtcttaattaattggttggagcattatttgcattaatatctctcaccaccctccccattcctgtccaagacctcagggagggccaggccagatgtatcatctgcaccagggagtcccctgcaggggcttccagatgtctgctaaatgaacacacagctctctctggccagtccaaggcaccccaggaggccaccagaagcctgcagcctccctccctccctcctgctaagcccaaggaatgagcactgagcagggaatggtaatctggacacatccatactctgcccttcagaaactacctagctgtcaccctgcacgaaacaggcaccagcctgagagtcaggaggcctgggctctgggtccacctagacagctgtggggcgcaggaccaaccgcaccccaatctctaagcctgggtttttccatacgtaaaaaaatgagggcagggcgggttagacactagaccagatctgtgatgacaggcccgttggaaggctggaggcggggcccctcgctgaaggaaaatgccttacctccagaagtggcccgccctggagtggccagcaaagggggcattgcccctgcgctggaatacacccagaagcagggtgtgagcaggagctgcggagaccttcagggacaggacagtctagggagggggtgagccctttgcagatctcctgcttatgccaggagaaaggtaaacacctctcaaacacacaaggagccagggggctgtgggctggaacctatagccggcaacagcgtatagcttaggattttatagcattgttctaccctagttatgtttcctatacttttgtttgtttgtttgtttgtttgtttgtttgtttgaaatggagtctcactctgtcgcccaggctggagtgcaatggcacgatcttggctcactgcagcctctgtcttccaggttcaagtgattctcctacttcagccttcctgagtagctggaattacagg

SEQ ID NO: 72 - DNA, 1199 bp, Artificial Sequence
  sequence of T7
ccatcttataaatatatcataatttactgaaaaatatttcagtaatgttgaaaggcctctgtgccatttccagcttgaggctattcctaaaaatccttgcacatgtctttcagtgcacacatgtatacatttcggttgggtatgcctaggagtggaatgactggttatagggtacacttacgttgagctttggtagatactaccaactgccagttttccaaagttgtaccaatttacattcctaccaccagtacatgagggttccagatgctgaacgtcctcactaatgcttggtaatgtctgcctttttcattttagtcattctggaggtagtgtgataatatctcatcgtggttatttgctttagcctgatgattaacgatcctgaccattttttggaacatttggagatcatcttttgtgaagtaactactcaaatattttgcccattttgctactgggttgttcaaaagattcattaaaagaacttcttttatatatgggtttgtagttgttatttagatattctagagactagccagatccctatactacaaatactttctcctactttgtagtttgcctttttactttcttttatatacatataatttttccccctccaaaagacagggtcttgctctgttgcccaggctggagtgtagtggtgcaatcatagctcactgcagccttgaactcctaagctcaagcaatcctccttcctcagactctggagtagttggaacaataggcacatggcattatgcgcagtcaactttaaaaaaaaaaaaaattgtagagatgaggtcttactatgttgttgcccaggctgatctttaactcctggtctaaagcaatcctcctgcctcagcctccctcccaagtagctaagaatacaggtgtgcaccaccacatctagctttactttcttaatggcgtcttttaatgaacagataattcctaagtttgatgtagtcaaatcatcattttttcctttatagtcagcatttatatccagttcaagtaaagaatatcatgaaaacattcttctttgttttcttttagaaactttcataaagtagcatttaaaatgtgaattttcctataatcctagcacttcaggaggctgtgccaccgcactctagcctgggcaacagagcgagaccttgtctcaaaataaaaaattaaaaaaaaaaaat

SEQ ID NO: 73 - DNA, 1602 bp, Artificial Sequence
  sequence of T9F
tgagcatctctgaactattgcgccatgtatttccaattttcatattgtgtatttgtatattttatatgtaatagtataggtgtaatatgtaaatatattttatatgtatttaaaatctttatattttgaagggttttgtttcaactattacttgttaatttcacagtccctttctttgatgttagcaaatagtaccttcatgaacctcagaggacttggatctgaatgtgcaatgccctctagtatttcaaataatagttcagttggtatagtatttttttaatctgcaaaaaacaatacttgctaatatagctatgttagagtaaacaataaatcgagaataaatttatagcctttgaaacaaaacaaaccaaaaattttactcctttttggctttcatccctgcactggtatcttaacttctgtttgtataaaagaataccattttttcacagaagacaaagaacaatcagccaatctaataattattttatggccatgctctgaaatacaattaaaattatgattgtggacaatatgccttttcgggacctggctgatggtatttctggtgtgaccccaactttccagtcagttcagggcaataaacattggatacaggacagctttggggatgaaatagaattaaatttagtgtagtttttgccacttttagctggatgcctggcgaggggttttgtgccctctgagagcctccgtcttctcaactgaggggtggttgtgagttttgggtcaaatgcttggtgtttagtagatgcttggagcttccatgaaacatgcaaccacggcgttgctgctatttgttcagatgcgagaggaacatgacttttggctgcctgagtgttctcatagcatctgggccttccttgtgagatcgtcagaaagtgtttcctgcacaaagcctgtactgcggccctggcgtggggctgattgtcccgctactctgctgtgatggctgaattcaaagagtggccgataggagcacgtatggtgggtgccttgttaacagctcatagcagaaacgtgacaagcgggagagggctttgggttgtcctgaacttcaaacacctgtaactgctgcgggaagagcggcacgtggatgaaacggacacagagggggaataggcaggaaaggacgcgggctcttttcgaagcagcaggtctcaaggcggccagccactggcgcagctgcagctgaagccacggcagagtctccatccttcccactatctgctgaatcagagaaagtggcaggcaacatttttagtgccttaaatttagaacgcttgctcaaaatcagaccctacttaaaataaggagcgataccctcatttcttaaatagtaaaaatgccctcagcagaattaacgggagtatcttccaacttcatatcctgaatggaaaagtctgtccaccatcccgaggacgtgtttgaagcgcagtgtgaaaatccagcacgtcgtggaccggccagacccctgtgccgtgagaggcggggcggcggggccgtggggcgctcgcactcccgagctcatcgtggcatgcgctgagccgaaaaccacgaggtagagggaatgagatc

SEQ ID NO: 74 - DNA, 1602 bp, Artificial Sequence
  sequence of T9R
gagcttgattgtctggccgcgaaaacagggcaggcccgtgtccaacatgatagtgaccagggagacgaccacatccatgtagggcctggggagagacaggagggagcggtgggctgaggccagcctaggtggtggccctgcctgtagtcctgtggactggctgatgccaacagcctcaggtgtgggctcctgccacccacctcgcctgccacatcttgcacatccccgaggcaactttcgatctgctgcactcggtcacccgtactgcccaggcaagggctgcccatacgcactctggacaggctgagtgtcctgccctgtcccccacataaggctgccggccatggcttctgcacctgggtgggatgcagacacgctgacctgcctttctctgcggggcagtggggatgaacccaggttggactgtggccttggccaagtgacctgtatatgaaactgggacaaagcccatctttggcacgtagcctgtggggtggcaggtgctcaggctttggtgacaaggtggatgggatgcccagaaagggagagcccatggctgaaggcgtgggcaggattgtggggaaggtggttggaattagatgcccagagcaagaatttattggcacaggtgggcagacagaggtgaccaaaggacaggtgtaggtcagcaggtggctgctagcacctacctcactctctggaacccgattcccttcatcctaaaggggatctcagaacgttccacacaccccctccgcctccaccctggccctcacccaggctcaccgcacagccaggtagcctggacacacatctccatgaaccacttgaagggtgtggcctccatcttgccccccatgatcatcaccatctcatccgtcagcttgatgtcgggttcccagccgagattgccgcccggcgagctttcaaacatgaagccaaagtctgcaaaaccccaaagagctgcctgtgactgggtaggagccagggcgggcaaggacgagtggtctgttttgaggagtggaaaaggactcttcaacaggagcaccccctccacccccaaaaggcaggttgtgttttcttggagacagtgatggggtgggtggtggggcagcaggcagagaaagagaagggaggaagtggaggaaggagccaagctggggcactgaacctggaccagccccactccgcccagctccagcttctgactcagagcaatggcggctctcgccccagctccctggggccggggccaggcaccctctacagcagaacagcttggtggccgacagttcggacctcagagctggaccctgacactcctggcagggtggtcctgggcattctcctctctgtggggtggggatccctatccacccctgggtgccggggtgaagggagaggagggtggcgctgtggctggctgaccgatgtggatgatatggcccttcttgtccagcataatgttgccgttgtgtctgtccttgatctgcagcaggaacagcaggaggctgtaggcggccatgcttcggatgaagttgtagcgggcctgtgcagagagcgccctgggctcaaaaaggccctggggcctgtgggcattct

SEQ ID NO: 75 - DNA, 1301 bp, Artificial Sequence
  sequence of T10F
aatcaaactggacccttatcttccaccatatacaaaaattaatgcaaggtggattaaagatttaattgtaaggcctcaaactataaaatcttaaaaggaaacctaggaaataccatctggacatcagccttgggacataatttataactaagtcctcaaaagcaattgcaacaaaaaacaaaaactgacaagtgagacctaattaaactaaagaacttttgcacagcaaaagaaactatcaacagaataaacagacaacctacagaatgggagaaaatacttgcaaactatgcatccaacaaaggtttaatatccagaatccataaggcacttaaacaactcaacaaacaaaaaacaaataacttcatttaaaaaaagacatgaacagacacttctcaaaagaagacatacaagtagacaaaaaacataggaaaaaaatacttaccatcactaatcatcagaaaaatgcaaatctaaaccataatgagatatcatctcacaccagtccaaatggccattaataaaaagacaaaaaacaacagaagctggcaaggctgtggagaaaaaggaacacttatacacttttggtgggaaagtaaattagttcagccactgtggaaagcagtttggagatttctcaaagaactaaaaatagaactaccatatgacccaacaattccattactggttagatacccagaggaaaataaattgttctacaaaaaagacatgtgcacttgtatgttcattgcagcactattcacaatagcaaagacatgaaatcaacctaggtgcctgtcagcagtgaattggataaagaaaatgtggtacatatacaccatggaatactacacagccataatagaagaatgaaatcatgttctttgcagcaacatggatccagctggaggccatcatcctaagcgaattaacagaggaacaaaaaaccaaataccacatgtcctcacttgcaaatgagaggtatatatagacataaacatgggaacaatggacactggggactcctggaggagggaaagaagtggcaggcaaagggttgaaaaactacttattgggtactatactcactacctgggtaatccgctagtagggatcatttgttccccaaacctcagtatcacataatatacccatgtaacaaacctgcacatgtacccccgaatctaaaataaaagttgcaattattaaaataaaataaaaataaagctagcaatgagccctatacatgaaaatcaataaaacataatcatggctgtatagaggggcttgtcatttatagc

SEQ ID NO: 76 - DNA, 1300 bp, Artificial Sequence
  sequence of T10R
aattttacacacacacacacacacacacacacacacacacacaatatcgctcagccttaaaaacatgctactaatcggctttaagaaaagaagaaaattctgtcatttctgacaccatggaagaacttcaacattacgttaggtgaactaattcaggtacagaagaatactacagtatctcacttatatatggaatgtaaaaatgttgaactcaaaagtagagaatggaatggtggttaccaggccttgagagagaggggtaaaggttggtcaaaagatgcaaaatttcagttaagaggaaggagtacaagagatttattgtacatcatggtgactataattgataacaatgtgcttttttcttgacaattgctaagagtagaatttgtttatgggcaccaagcttgattccaagtctttgctattgtgaatagtgctgccatgaacatgcaaatgcgtgtgtctttttggtagaatgatttgttttcttttggatatatacccactaatgggattgctgggtcaaatggtagttctaagttctttgagaaatctacaaactgctttctgtggtggccaaactaatttacactcccattaactgtgtctaagtgttcccttttctccatgtcctcaccagcatctgttgtttttttgactttttaataatagccattctgactggtgtaaggaggtatgccattgtggtttgatttgcatttctctgattagtaaaatgaagcattttttgtatgtttgtcagccatgtatatgtcttcttttgagaaatatctgttcatttattttgcccacttttaaatgaggttatttggttttgcttgttcaattgtttaaattctttatcgatgctgtatattagacctttgttgaatgtgtagttttgagaatattttctctccttctgtaggttgtctgtttactcttttgatagtttattttgctgtgcagaaactctttagtttaattgggcctcatttgtcaatttttgctttcgttgtacttgcttttggtgacattgtcacaaattctttcctaaggtcaatgttcaaaatggtgtttcctaggtcttcttctaaaagtcttatagtttgagggtttacatttaaatctttaatctatcttaagttaatatttgtatatggtgagagaaaggggtccagtttaattcttttgcatatgactagccagctatcccagcactatttattaaatagggagtactttcctcattgcttatttttgtcgactttgttcaagatcagatggctgtaggtgtgtg

SEQ ID NO: 77 - DNA, 2001 bp, Artificial Sequence
  sequence of T11F
tctttggggtatgattatatgtctaggtaaaactcttttaagaagatgaagcagagaggattgaattgacaaagacagctctttaaaaattaaggttatttcaagactaagaacataactgcttaattgcaggtaataacagaaaaaacttggaaataaacatcccattatttgacctccaaggcagaagactggcaccaaggaaatggcagcttcgtccctttcctgtcttgggcattggtaaaaggagttgtctagacatgtttgatttctgtttcagcccttattagtagttatgccatggcaaattattcaatttctctgactcagtttccttattcagaaaatggaagcataattcttgcctcatagggccatgaagattaaatgaggggtgtcttgaagtgtctgggacataaatcttcaataaaagctaattccttttttttacagttatctcaaaccttttagtgaattggtgcttatcagtgagctttttaggtgatgcaaagaccctgctttgctcattttaaggaacagttatttttctttctccattttgaagtttcttgtttgctgcctggttgatatggtttggctgtgtccccacccatatctcatcttgaattgtagttcccataatccccacatgtcatgggagggacctggtgggaggtaattgaaccatgggggtggttaccctcatgctgttcttgtgatagtgagtgagttctcacaagagctgatggttttataaggggcttcccccttcgcttggcactcattctctctcctgttaccctgtgaagaggtgtctcctgccgtgattgtaagtttcccgaggcctcccggccatgtgaaactgtgagtcaattaaacctcttttctttataaattaccaagtcttgggtattccttcaaagcagcatgagaacagactaatacattggtttaaattagaatgccaaaatttaaataatttttatcttgaatagtagatggaattaactttctcttgaaagatatattttaaaaaattgaacttacacagacagttttgaaatggtcttattttagttttatttatttatttattttgagacagagtctcacagtgtcgcccaggctggagtgcaatggcacaatctcggctcactgcaacctccacctccagggtcaagcgattctcttgcctcagcttcctgagtagctgggattataggcgcccaccaccatgcccagctaatttttgtgtttttagtagagacggggtttcaccatgttggccaggctggtctcgaactcctgacatcgtgattctcccacctcggcctcccaaagtctcaggattacaggcatgaaccaccgcgcctggctgaaattgtttttattatagatgttgcttgtgcagttttgttagaagttcgtgacttttaacagtgatgaaaatacttcgtcattcaacaggttatttttctgctggttgtaggttatttgtaaggaactgttagtctcctatctgggtggacatgtaatagtatcagttactgaaccagaactttaaacacctttctgatactcacactgggaggtcaccaagtatctcagaataaaatgtcccaaactgaacctaccatgttcccagaaacccagcccttctcaaattcccagacttggtgaatgggagcctgtccttgcagtcttgtagcccaaaacctagggcttaagaacaccttcttccttactcccatatgcaacccatcaagttccatgcatttcatctcctaatctcaaatcccttcacccatctccacagccaccccgctagtccgggctgccattgtctctcacttaaaatgttgttattgtctaactgaccttcctgaaccctttcttgcctctttccagtttattttccacactacagccagaaaaagcttttcaaaatacgcatctggtcacctgcatacctgtctccagaccacatacaataagccttca

SEQ ID NO: 78 - DNA, 2001 bp, Artificial Sequence
  sequence of T11R
tctgccagcggctcccgcgccaggtcctcgaagcgcaccaggcggtagcggccgcgcaggaagggtggcggcttgagtgtggcggcctcggcgatgcgcacgtggctgcggcacacctcgcgaatcaggcgcaggtgagggtcggcctccacccacttgccgttggtgcccagcacgatgccgttgtcgcgtgccagtatcgggcccgccgcctcccgggagcgcagcacggcccgcgggtcgcgcaccaggtgcacgatgcgcaggttgagcgcggggtcgctgagcagcgggtagagcacctgcaggttgaagaagcgcacctccttgagcaccacgtggctgtaggagcggcaggcctcccgggccaggctgaatggctgccgcgtgcacagtgtcttgcatacgtcctgcttgctgatggtgcctcggggaaaggcgctgcaggcgggcggcgagcacagcgcgcggctcgttgcccagttgaaaaaggcggacaggtttcggctctgtggcatgtaggcatcaaacacgtccatgtcgcacaaaaagatagagcgcatcaggtcgcgcacggccatgtgcagcgttgccgcgctgccctgcgacagggtggtccacacatgccacgcgggctccatcaggtagaagacgtcggggtgctggctgaagagctggcccaagaaggatgagcccgagcgccacgaggacagcaccagcacgtgcacacgatcctcgccgccggctggggatgagggccctggccgggagatgatgaagagcaggaggcaggtggtctgtgccaggaggagcactgtcactgtcttgctggagaaccgtggcagccacatgcgggcggctgggggccttcgggtggagtgggcaactttagggacccgggccctcatgcccatcccatgccccaattactgcccagtgccctcagggatcagccctcagattcggctaccctacccattggacttcccaagactcccaaggtctcagtcgagcactttcccaggaatacggagtcaagacataggccagaatatagtctgtgctcacagcagaagtccagttgcagaataatgtgggatatcatcaaactgtctacctacccacccacccacctacttacatacctacaggctatctatctgtagagagaaatactatgtttcaaagagaactcctgtcttttgcttcaggatacctcttagagagacccttttaggttgtggagctaaaagggcttgatgggggcttcggtggatgtcagagcaccaccaggctcgccgaggttgaatcctggctctgccacttcctagcctatgatcttgcttatgaagatcacttaaatctctctgtgacggatcactttacccgtgtgtgaaagagggataattccggtacctggctcacaggatctggggggattggggggttattataatgaagatgggggaagggaacacgcagtcatgcccataactgaggattgcaccttttacaaggtgtgcttctgtattatataatttttttaacaggcaggtataaaacttttgtcagccaggcgcggtggctcacgcctgtaatcccagcattatgggaggccgaggcgggcggatcacgaggtcaggagatcgagaccatcctggctaacacagtgagaccccatctctactaaaaatacaaaaaattagccaggcgtgatggtgggcgcctgtagtcccagctactcgggaggctgaggcaggagaatggcgtgaacctgggaggcagaggtggcagtgagctgagattgcgccactgcactgcagcctgagtgaagagtgagactccgtttcaaaaaaaaaaaaaaaaacaacaaaaaaaaaacttttgtcattaaagataaacaagtaaataaagtggacaaagaacagcaactgttgtcatcactggtggggagtgaagtgctgtaggcagcatgggctccagaaggagggtgtcctggag

SEQ ID NO: 79 - DNA, 2100 bp, Artificial Sequence
  sequence of T12
tggcatccagcatggagcccacagcttccctttgtagaattgcccagttgttgcagagtgctttggtctcaatgggtctaaagctcttgatgatataagagcttcaacttccttttccctctcctccccgcaggctgcacaatgtcctggtgaatcacctgggacttcagagctctgccaccctgggtgtgaagctcaggtctgctcttggtagcttggtcagtgtgaagtacaccgtgattttgggcaagctgcttaacctccctggccctccgtttcctcatctgtagaatggggatattcacagaacctacttgtagggccatggtgaggattaaatgatgaacagtgctggcaaacaggaaatgctatataagtgtccctagcaatatacacaccgcacatcctcagtcaccacgtgtgttcactgaggtatgggccatgtgtgggtggaattgtgttccctaaaaagatatgttgatgtgctaacttgaggtccctgtgaatgcaggaaaccaaaatatttcttctcaaaatagtgaggattgttaagttaaagacactgaaaatgcaggggaacactgccttggcctctacttgcctgatgacaggcacgaatccttccttacttaagacacatcacttgcttatcagcccagagaaagcacctgcaggcaccaggaaaatctaggaacagattttactctcttcccacattttcccactttttcaaacactgaaactgctctctcctttgtcttgtcactagataggatttatggctctttgttaaaatattgtttaagcaaggcttctacgccactagcttgagagagaaatacttttgaactgaggcctcttccgcatgataggcagagcatgcattaatacatttctgcttgtttctcttttgttaatctgacttttgttttccagagtgtctcaaataagaacataaaagggaggggagaaattatagtttctcccctacatgaacttattcggatatagggtctttgcagatgtaatcaagttaagatgaagtcatatttgattaggataggccctaattaaatatggttgctgtctttataaaatgagaagaagagaccaggtgtggtggctcacacctataatcccagaactttgggatgccaaggcaggaggattgcttgaggccaggagtttgagactagcctgggcaacacagcaagactccatctccaaaaaaattaaaaattagctgggcatggtggcatgcacctgtagccccagctacttggtgggctgaggcaggaggatcaattgatcccaagagttcaaagctgcagtgagctatgatggcaccacggcaacctgggtgacagagcgagaccctgtctcttaaagaagaaaaaaagaggagaaaaaaacagagacacagaaaaaagtccttgggatgataaatgcagaaattggagccatatatccacaagacaaggaaccaccaggattcttgggaactccagaagctaagaagagggcatggaacaggttctaccctagggccttcagagggagcgcagccctgcagacaccctgagttcagacttctggcctccagaactgcgaaagaataactttctgttgttacagcagccctaaggcactagtacaggtgacatgtattgctcttctgaagagcagggtgtctacagcggcagaggtctgggtcctggcacgtgccctttaggattccaatatccttaggggcctgctggtgctgacagttccagaaccataagacagaattcctgcgggccagtttggaagcagagacaggaaactggaagagcccttagcctgtgcttgggcttaaagccctttagcttgtggctttaactctgaaacttctagagggcatcttgcaggtcagtgtgaggtacagaagttgtcacaagcttcctggctcaaagaaagtgagacttcacgaacttttctggacatcacaccagcacttatgaagttatcttgttaagcacagatgaaatcagaaatacaggcattcaccatcacttaaacaaagctcagattgtagagtgcgaggaagaatcggtggga

SEQ ID NO: 80 - DNA, 1700 bp, Artificial Sequence
  sequence of T13F
cagatctctaaagtattgggtgtggactagagctctggacggcctaaaggaaaggaatgtgccggttcacagggacccgcggctaagctcaagggtaaaatacagctttacaaagcatctttaggctgttccttcccaaacgtgcttagaagggaacagggaaaggcgggtgtgttttctcactgaggttcttctagtggctggaatctgatagagtaccaagttgtagggatatggatatattttccctttggcactccataaagctaaatgttgggctgaaaaaaggatgcagcctataaacaagtatttttcctgaaaccaactgcatgaggaaacgctgcgctccccctcagggagcagtttctgaagccagctgagcacagctggcactggccagagggagccctccaccctcccaccacgtatgcccacctgcaaacctgggttctgagtccccatgcaggggacagacctgaaaattccagtttgtgtcctttcaggtcatcgacaggaatgacagcctggcaagctgcagtgactgcacacagctaccctgtgagctccacttgtgtgggtgcaggtgggcgacaggagtgtgtgacacagacaggcactccaccaggaggaaacccacagcagacgtcaaccatcgctttattaaggctgcgagtcggggggctgagtcatgcactccacagacacccccactgctcccaaggtccacttttggatgaccctgaaggcagagactcctgagatctgggccacaatctagggtgagccacccacagtgccctgctggacaggggggtatgcggactgcacgggggggccctcagcaggggtcttcctgcctagggtggggctggctccagtgggtcctgggctcaggcagggggggtggcagggaggcagggacatccccccgccctctggcctatggctttgttgccctattgccaccagcgcagaagcaatgtgctataccgtgaggtgatgaagaagagccccgggagggagcaggcagctctgtgcctggggcctggccagacctcaggggtgctgtggccctgctcctgttccccctcagctcctcccagcaatgggtctcctccagtggaggtcagtcactcagaagtggacccgcagcacgtcttggctagcaaccggccgctggcaggctgtgcacgtcatgggcagggagcgttgcttctcacccaggcagggtcggcacaggaggtggccgcagggcagctggtacaccggctcctttttgaagtagggagaaaatactcttttgcaggaggcacattcggggcccaggatgctcccaggctgctctggtaaatcaggaaggaaaacaggccagggttaggaaagctgctccatggtccaggctgctctgaggggcagagccttcccaccgtgctgctgcagcatctggcttcatccctcccgagtccatcccagtctgatcaggtaggggagtggaagcgggagagggagcctgggaacccgggaggcctcttctctatcatctttgaccaaatctcagtgcctctacgaatgcttgagaagagctggcttctgagggcagcaggcaggactgggcccttcctcctggtctcccagcaaggtttactttcccctgcgataggtggccaaggctggagcaaggcacagctcactctgacaag

SEQ ID NO: 81 - DNA, 1701 bp, Artificial Sequence
  sequence of T13R
gaatctgaccactcagtcccacatcccaggattcagagaaaaagaattccagtgagggctctggaccccacacagctaaggcttccagggtttaggcaagccctgagggacacccatcataattacccagacgggggcccagcatcccgccccagcattctgccttgcaaggagctccctcaccagggctcagggaagggacagcctgcagttccagcaagggaggcctgcagagtcagccacaggtggccactatcggttgcttggtgccaacttagtgtgagggggcagggcccagactcgagggtgccattaccgtcccccatcgtgtacttcttttcctcgtagcttgagtctgtgtattccaggagcaggcggatggaatgggccagctgggagagatggcccacagctcgggtcagagatggagggtccctgactttgtgacgactctgcacaaggggagccccatctcctcctctcgttcctgcctcacccgcccccaccccgcacgcccagccacacgcacagacagcggcaagcacagaccccgctgtcagggacagccctgaagaggaaccgtccctagagcccgtcctgcagctgctccacacttccccgcccccacgcacccccgtcccaccgcccagcggaccctggctcaccccgcggatgttccagtaccccagtgtcatgggcatggtgctggttgctgtggattctgcagacaggcctcagcggggcggggctcagcgtttgtgagaggcccagagagggtagaggggaagccttgctgcgaccccgccccacggcccgccctgcccccgaaacgggccaatctggaggcctggagcgcgctcatggggctaggagtaggatctcctcccacctcccagccccgtgggtttcaggagagagatcaggacgcccagaagcccagggcgggggagaactggttgagtccaggggttcaagactgaactgagctatgatcgcgccgctgcactctaggttaggcaagaaagaaaggctctctctaaaacagagagattctgaataaagtaataatagcctaataaagaaaaataacacaaaagaacatttggtgctcagggattcactggataagttttcaaaacttttcaatgtatgatagagattgttataaactgcggacatacgtggcatgacagacctaacgtgggaaggacaacacaggcaaggatgattataactcactgtcacttatcagcctaaatccaaacgtcaggaataccgcctcagagaaaagaaaatgatgtttttgtcataagtggtgctgtgctcctagggagcttgctgggtgggaagagagacagaaaggtggggagcaggggctggtggacttggggagggaggagaaagcccatgtggaaacgttagaatctggggtaatcagaggtctttgtattcattcgttttgtaaatttctcaaactctcatgttaaatcaaaataaaaagttaaaaaaaaaaaactaccaggacagacatacacaaatattattaactgaaataaatgttccatcaaaaaggacttaccttaactacatgagttatattatgatttctattattattattattattattttaatattagtatccatccagcacaccactggtcttcaagtggaggtaactttgcccctcaggggacatgt

SEQ ID NO: 82 - DNA, 1482 bp, Artificial Sequence
  sequence of T14
  misc_feature (132)..(978): "N" stands for any nucleotide on various positions
atcagcccccacatgcccagccctgtgctcagctctgcagcggggcatggtgggcagagacacagaggccaaggccctgcttcggggacggtgggcctgggatgagcatggccttggccttcgccgagagtnctcttgtgaaggaggggtcaggaggggctgctgcagctggggaggagggcgatggcactgtggcangaagtgaantagtgtgggtgcctngcaccccaggcacggccagcctggggtatggacccggggccntctgttctagagcaggaaggtatggtgaggacctcaaaaggacagccactggagagctccaggcagaggnacttgagaggccctggggccatcctgtctcttttctgggtctgtgtgctctgggcctgggcccttcctctgctcccccgggcttggagagggctggccttgcctcgtgcaaaggaccactctagactggtaccaagtctggcccatggcctcctgtgggtgcaggcctgtgcgggtgacctgagagccagggctggcaggtcagagtcaggagagggatggcagtggatgccctgtgcaggatctgcctaatcatggtgaggctggaggaatccaaagtgggcatgcactctgcactcatttctttattcatgtgtgcccatcccaacaagcagggagcctggccaggagggcccctgggagaaggcactgatgggctgtgttccatttaggaaggatggacggttgtgagacgggtaagtcagaacgggctgcccacctcggccgagagggccccgtggtgggttggcaccatctgggcctggagagctgctcaggaggctctctagggctgggtgaccaggnctggggtacagtagccatgggagcaggtgcttacctggggctgtccctgagcaggggctgcattgggtgctctgtgagcacacacttctctattcacctgagtcccnctgagtgatgagnacacccttgttttgcagatgaatctgagcatggagatgttaagtggcttgcctgagccacacagcagatggatggtgtagctgggacctgagggcaggcagtcccagcccgaggacttcccaaggttgtggcaaactctgacagcatgaccccagggaacacccatctcagctctggtcagacactgcggagttgtgttgtaacccacacagctggagacagccaccctagccccacccttatcctctcccaaaggaacctgccctttcccttcattttcctcttactgcattgagggaccacacagtgtggcagaaggaacatgggttcaggacccagatggacttgcttcacagtgcagccctcctgtcctcttgcagagtgcgtcttccactgtgaagttgggacagtcacaccaactcaatactgctgggcccgtcacacggtgggcaggcaacggatggcagtcactggctgtgggtctgcagaggtgggatccaagct

SEQ ID NO: 83 - DNA, 1680 bp, Artificial Sequence
  sequence of T17
ggcgccactacgggattaagcctgaaacccgagcggccccggcccccgccacggccgcctccaccacctcctcctcctccacttccttatcctcctcctccaaacggactgagtgctccgtggcccgggagtcccaggggagcagcggccccgagttctcgtgcaactcgttcctgcaggagaaggcggcagcggcgacggggggaaccgggcctggggcagggatcggggccgcgactgggacgggcggctcgtcggagccctcagcttgcagcgaccacccgatcccaggctgttcgctgaaggaggaggagaagcagcattcgcagccgcagcagcagcaacttgacccaagtaagtgcaaaagaaattgccccctgatttattgctgaaacctgtaaggctcgaatgtgcaaaactgatagttttactaacctataaaaacgtctagacgcctacccaagcctaggcgaacaacatgcatccataaaaagagcttcccataaccacctaccctgggcgctcagttagtacggtaaacagagcgcgagcattaaggctttttatgataattccccacaagttgtgaaaagcgaccatccttggtgaaattaatttaacgacctctcttccccaccctgtggtctctccctgcctcccctcctctcctctctccccgtctccaaacctccctctttgtagacaaccccgccgcgaactggatccacgctcgctccacccggaaaaagcgctgtccctacaccaaataccagacgcttgagctggagaaagaattcctcttcaacatgtacctcacccgggaccggcgctacgaggtggccaggattctcaacctaacagagagacaggtcaaaatctggtttcagaaccgtaggatgaaaatgaaaaagatgagcaaggagaaatgccccaaaggagactgacccggcgcggtgctggcgggagcgctcaagggcagcggatttgttgttgttgctgttttcctttgtgggtgtttggtgcttgatttccagaaactctccagcgacttggacttcttcttctttttttttttctttttagatagaagtgactgtgtggttggtctctgaggtatttgggggactctgtatttgctcgtttacgtgttggaaaaaccaagtggctttggggtttcgccctatcccactccctctctttcctgctccattggttccttaagaaatgctatattttgtgagtgcaagctggcttggggagccctctcttgtgtaaatgtcccccatgtttctgaaaagtgctgtagtttagtcccctcacccccagcactgcccaaacaggggccaagtgcgccccaattccaagaatgaaggcagagcgacaacagtgcggacaccccggctgctagcccacggtgaagcccggcggggttgcccaccagttgcgaaagccccctttcctcagggagcacgcgggacctcggtggagatctccagtgaggcttagaggagcccagggcctcgggcgggttggggtttgtcctcagtgcattggacgcgctgctctctcccctgaaggctgggctcgcgtgggcggccgcgggtggtggccctcccggttcctgcccgaggaccagttgtaaatgttactgcttcctactaataaatgctgacctgatca

SEQ ID NO: 84 - DNA, 919 bp, Artificial Sequence
  sequence of T18
gatcatctactaggttgaaaggagagaatatgacttccagaacagcactgatgcttaaaaaggatgcctctggaagaaaaggaggaagaggagcaagtgatgggagaatacagtgggactttgggcaccatagggtcatcctgagtttttcaccaaaatcaggaacagcggcaaaactggtttcactgaagaagacacacgtttggagacatgtgtagtctccaaggattctcacttaacaaagcctatttctgttgttaaaaacccctgcataatgcacccacacacaaacacaaggcttggtctgtgttcctggccacctaaagaaactgattcccagtaagtttaaacctgaatgaaatgtttctgcaaattcagcctcaaaattcctcctctacctggcatccctggcttgtaaactatgtgtctcattagttcataaacaaagcagccctgactttgccttgtactcaaccacagccctaggagccagtagaatttgtccagaggtgctgggctttggagcccaagtggacaaagtcagaccccctttcctcagggcaaagccctcccacagggctgggaccccaaaggctatgctggaagcaggttcagcagcaggatatcaaggggcaaagctcctaattcaaaatcttcctggcttctgaacaaccattaggatggacagagaaaacttttgccctgctctgagagggtcccacagggcttttggaagcagagccaccattgagaaatccctttcaacctgagtagtaattcagatttttctcccactcctgcacaacttaatttgctgaatggaaaattcagccagaagtgatgggctgcttgaaatcaacaaaacttgacacattcttcccattttcattttactttattgttaaacacataattgatc

SEQ ID NO: 85 - DNA, 1174 bp, Artificial Sequence
  sequence of STAR A1
gatcaatagaagaatggagtttgtgtttgctagccatagttttgacgtgtgggagagttggagtctagaaggttctctggacgaatgtcggcttgttaactgcaggaattcctctgtaagtctctgtccttacagaaaatggcccgaaattgaaaaaccctacttcttggaaaacagaaataatttgtgtaatgaatgttgcaggcggtgttggacgttcgtgtggagatattggcaatggtaggagacgatggtatcacacgttggatcgattaaaaagaaaaacagagtctctccatttgtgagtttctctcttttaattacttttgttactttaacatccttaggattcacagacgaaaaacagagacacccaatttttgtgtttcgagactgtgtcgtgtgttgtgtagttggtatcaaccaacttatatctgtaatcattgtttctttttatttattctcggtttgcagaaacatccgatgagcttgtcttagagggacgtttgttgttgttttctgggtctggtcgtgatgaactcgaaagcattgtgtgtttggttagtagtttgaaataggtgtgtgtattgtatttgtatatgctgcgtttgtgttttagagatcatcgtacataaaacacatcatcgtacataactaaaatttgagctaaactacaaaagaaagtaaccttcatttttagtcgaaccaggccccagctaggcagctatctcgtaaataagattgctggcttacgatcgtattccacgtggcaatttatgtgccgtggatttaaatttgtacgtggcatgagtgttaggagaatgtccacatggcttgtagttgttagtcccacgctctgaaccagagcaaccggctccttacacgtgttcggcttaaatccatttttcgaatgagattacacttctaaccttgtctccctctcccgcttataccaccaccactctcacacaagtctctcaagtcacaaactctgtttcaaaccaaaagggaactttgtgtgtgttgtcgagttttatggtgactgtaaaccctagccaagctcattgtttgcctatgaaaatgagtctaccgggtttcaatactcttccccacacggcaacaacgataccggtttccatacggagcaataggacgatgtcgttttttgaggatc

SEQ ID NO: 86 - DNA, 910 bp, Artificial Sequence
  sequence of STAR A2
gatcaaaattttggtttcttcgctttgattttcttcttcttcttcttcttcttccctcaagttccttagaatatctttctcatccattttttttggttcttgttttgttaagtgaacattttagttgattttaaagtgctaaacttaaatgcagcattttactaatataaaattacgctccattattgaccttatatacatagaacaaaataatgttataatcttcgacttttttctaacaaatattaaccaatcatgtcactaagaaattaaaaaatactagtatataggaatctagtccattgtatatatcgtaaacatggacacttcaccaacgaacatgcatggggtctttttataaggttctttataccgaaaccattgttttggtttttatgataattgagttagttttgtggcttttccgttcaactaaaagtctcattatgtcaactgctattaaaccggcgcacatggcatgttttatgaaattaaggtcaattggactccaacttttcaattattaaaaaaaaagaaaaatgattgttgtatgccttggcgaagaagaaaagccgctagctttattcattatcaaacgaaacaaaaacaacaacacatcactaagaatcttaaactcttaaccttacatcaaagtaacttttattacattgcatacaagaaaagaacaaaccagcattattaggtttgagattaaacctgttcccacacatatacatagagatatgaactctacaatttcaaaccagagccttgaagtttctcctcaacaatcatgtcgattttgttttccatttcaggagtcatataactcttccaatcaccaacttcccctttacggaaaaaactcttgaaacttactccttccgacaagcttcctgttttgttgatc

SEQ ID NO: 87 - DNA, 906 bp, Artificial Sequence
  sequence of STAR A3
gatcattaatcgcagatttttacaagacagcagcttggagagcaacttacaagtgtgttataaactctgaactcaacttggaagatgttgacgttccaaatgaaattggaagacaaactatcttcccaccaaggacaagaaggccgtctgggaggccaaaaaggctacgtatcaaatccattggcgaatatccggttcgtatttgtaggagtcccattttttcgactttatctttattccgtatttaattttcaattttatgtggtttaacagaaatcaaagagcgtgaaggtgaagattaacaggtgtggcagatgcaaaaagactggacacaacaggacaagctgtagtaatccaatctgaagatgttttaaaatcggctatattgatagaacgatgaccattttattattgtttttgtgtttggaaatggttatttttggataaaatatgttgcattctattttataattttagtttcgacttattacatataaatctagtaaggtaatatattagcaaattacagataatgatgaaaaacatggacaggtataggtggataagatataaataaggtaggactgaattgttacccgttaataatgaaagaatatacgaaatactaaacattaaataaggaagttactaattattggacaacaaaaagtttaattcctttaaaaagaaattggaatacagacagtttcattgacctaattaagtacttctttgaaaaaaatcaaactaggagaatagaagttgtaaataattgaagggaaacgtcgattcggtgaaaaggttttttaattagtatttaaagggaaatatcttctcttatacagaatatcttgccccagaacaaatcgcctcaaatactaaaagtgtgtacatcttctcttgatc

SEQ ID NO: 88 - DNA, 782 bp, Artificial Sequence
  sequence of STAR A4
gatcaaattcatatgcttatttgtgattatactttgctttgattcaggaaatcaaagaagatagctccaccttacagggtgatactacacaatgacaacttcaacaagagggaatatgtggttcaggtgttgatgaaggtaatacccggcatgactgtagacaacgcggttaacattatgcaagaagctcatatcaacggtttggcagttgtgattgtttgtgctcaggctgatgcagagcaacactgtatgcagctgcgcggtaacggccttctcagttctgttgaacctgatggtggaggctgctgaaactaattaaactcagtatagattttcccaccttccaggactctctatttagtcaaaaacatttgttgttttaatgtatataatatcagaaatttggtacaagactgttactatatgcaatgaaccttgcccctacatagatctgttgtgagttttaagtgttttcatttggaacttcagaatgcaaataaacaaaactttattgaagtcaaatggtgttacagatgaatctttctgattctgtaatcactaatgtaaatgtatctaagcaattgtaagggagtgacgtgtttcggtttcatctcgcccaaaaaagcattcaaacccaagaaacctgcagtttcaagacattgatgggataccatatagatgtatcaagcatcaaccggagtaagaagcgactgaatgccgaagataatgaaaagcattccaccggaaagagccacctgcaacaacataagagctatttgatc

SEQ ID NO: 89 - DNA, 1356 bp, Artificial Sequence
  sequence of STAR A5
gatcctgtaaaacataaagttagagataattgtccgatttgtttgcccttttaatttggagagatatgaaccaaaaacatatttcggaatgggtccctttttcatcgtgtgtaacagttttaccaaacagtaatactttgtgaaagttttgattaattaatgcaaaaagattagaaaaaagcgaaactaatttttggattacactagaaaaaggttaaaatcaataaccaaaaaaagaaaaaggttaaagttacaaaacacaccggtttatagagtgaaatgattattgttctgttgaattgacgtgccagcttagcatcaccttactattatcagtcacctatatatcacaattcacaggcttcttgctttctctcattggctcgtcttcttccctttcttctccaatcaccttagcttgctgatcaggtaaactagattggtgtttcgtgttgttttcttctcaacttaggtgtttgatttgagaagtttttctatgtatgttggcatgttgcgttcgtagcattgcatatcaacggataggtttgaataggtagaattaatttgattgatatatgaaagaatgtttgtatatatactctaggtctaggttattgaatattgagaaatttattttgttaggtttagatgaattattcttcgatgagtggttcaaagttcaattggcaagtcttttcaatgattgtagtattttggtgatgataagtaagttgttaatgactctcaagtctgaattcatgttttggttttgtttccttgtaaaaatgtgaacgtttttcttacagaagctttcacaaacaaagtatggttaattgagtgactaatccactaattctcttttgttgttttatatcgtttattaggtaatgttttttttttttgggtgtgtaaaatatgatactgactcaagattttatcatatttctgaatccataagctaaagtacatttgagagaagcaagagagatagaatggggcgtggagttagtgcaggtggaggacaaagttctttgggatatctttttgggagcggagaggctccaaagctagcagccgttaacaaaactccagctgaaactgagtcttctgctcatgctccacctactcaagctgctgctgcaaacgctgttgatagcatcaaacaagttcctgctggtctcaatagcaactctgcaaacaattacatgcgtgcagaaggacaaaacacaggcaatttcatcacggtatgtctttaattctttcgctgaatcgagtcctgtgtgctggttatcggatagcaaaaacatctgtatctttacttttcttagattagttgtctgaaaatgaaagaagatc

SEQ ID NO: 90 - DNA, 1452 bp, Artificial Sequence
  sequence of STAR A6
gatcgactggtacaatgctagaagccctagaggttgtaggtgatagccacgatacatccttaggtgatgtaagtcaactgaatataaatggccatttacgtagacttcatgtcctagatgatccctcctattataacgtgaatctcggtttcttggtgtggaaaacgaaatgattgatatgtttttgtcagggatttgaggtggtgaacagtcgttatatgactagttatgatgatgaagatacaccgccaggaagtggattcaggacaaaactaagagagttccataagaggtaaatgacgcattaactcatgcctctcaacattttgtcggcattcaaacagatgcattcaagtctcttttaataaacacaagaatcccatttgtttattgttttgtttgtatgcagtgcggcatcattcacagaactagataggaattacctaacaccgttcttcacaagtaacaacggagattatgatgatgagggtaacatggagcaacaccatggtaacaacataattctctgatctcttgtttcactattatttttgttgttattccgcacccaaaaccatgaaatttacaattggggttattgcagaagaacgaatcccatttactagaagaggaaatctaaataaccgcggctaagtttccgagatgagaaatctaatagtgttttttcagcggcatatatatgtacataaaacaaactggatgtatgggaggaggtagtgacaaaggatttgttctaagctaggtttctctataatatggtactgtgttgttggtgtaaacctgaatggatattgttaggttgaaactaattacattcacacaaagaaagaaaaaaacttgaagaaggccatggctggtttatactgaaccacgaattttgttagttttaaactcttagggaaaatgctataatgccttttttgtcttgtagtcgtgtttggtttgaattaaaaaaaaaatagagaacgtcacggcacgccaaaagtgtggaccttgtttattcgccggaagtaagtaaccaaaaacgcttctaatctttcgtttacaacaaatatctctctctctctcgctctctctcgctctctctttcttcttcttcatcttctttcatggctgttactggctgggcaatcacaatctgaattctttcttcctccttgtctctctgattttcgccgagttttgggggctcttgttgttacacgatgagtctggtggttggtcagtctctgggtttaactctagtcggtgatggtctttcgttacgcaattccaaaataaatgtcggaaaatcaaagtttttctcggtaaatcggaggagattggcgcgtgcggccctggtacaagctaggcctaaggaagacggagcggcggcaagtccttccccatcgtcgagaccggcgtcagttgtgcagtaccgacgagctgatc

SEQ ID NO: 91 - DNA, 1085 bp, Artificial Sequence
  sequence of STAR A7
gatctatcttatattgttagttcatgtttgtttttaaagactgtttttatgtttcaatggtatattactgactggggcagtaatattgttgaagtctgtagattatggtcgcatggctgaaatactggtgcagagggctgcttctcctgatgaattcactcgattaacagccatcacgtgggtaagcagaataaaccatgcttctgcttggcgtcttccagttatatagattggtactattttgacttctcgggagattcatatactaagaatatctgctttttattaaatgttgtagataaacgagttcgtaaaacttgggggagaccagctcgtgcgttattatgctgacattcttggggctatcttgccttgcatatctgacaaagaagagaaaatcagggtggtaagtttgcttctcctcctcagtgatggaaactgtaggttttgtatgcatctttttactttctttgttttttgatttttatttgcataaggttgctcgtgaaaccaatgaagaacttcgttcaatccatgttgaaccctcagatggttttgatgttggcgcaattctctctgttgcaaggaggttagtttttctctattgttgtttttatatccgtttgaatattattaaatcgcgcctgtttatttgtgagtttttgcattgagcaggcagctatcaagtgagtttgaggctactcggattgaagcattgaattggatatcaacacttttaaacaagcatcgtactgaggtgaagaaactggtttttgcttgggcatcattcttttctagttagcctttttgtttatcgcgttatagctaaattggtaatgctgcaacaggtcttgtgcttcctgaatgacatatttgacacccttctaaaagcactatctgattcttctgatgacgtaagttctatctccctgactgttcgtttgattggttggtgaactttataatataaaggtttggttttgtctagtaataaacttatttgatatttgaactatctggacttggaaatatactttaggtggtgctcttggttctggaggttcatgctggtgtagcaaaagatc

SEQ ID NO: 92 - DNA, 696 bp, Artificial Sequence
  sequence of STAR A8
gatcatctttttctaggtagggaattgcttatctcggtaagctaagaatgttagaaacaaagaactaggacagaacgggaaatggagaaggaggttagaatcaaagaacagtaaatggagaaggaggttaatgtgtatttcattctatctacattttaactaattgagtgtatccagtcttatccattaatgtaattacaagaagaatagtaccaagcatgtaggttatagttttcactttactgggtgaaggtttctgtagttcaagtgggtcaaaagtggtttgcggaaacatatctctaataatttgattgagaggctcctcgcactcacatggacttaaacttttgtgtattatacaaacatgattcacatacacatctcgtgtatattgcaatacatttggtaaattatctgaaaataataatgaaggtttcttcaaaagaggtccaggagctatttccattaacactgttatactgaacagtatacaaaagaagactgcagtgcgagaatttatggaggatgataatgcatttgagatattcttctgaacactttcatatcttttatgtaaaacatttttgatgagaaaatcaccagtagtatccaaacactttaatccagatgatgggaaaatgctttgtttaaacctactacgaagtatgcttaatacttcattattaccagttgatc

SEQ ID NO: 93 - DNA, 925 bp, Artificial Sequence
  sequence of STAR A9
gatctggtttcggtaattgttgtttccgggaattgagtatagaaacacaaatacatatttaaccctgatgaaagagggtgtaaacttgtgcagatagatgcgaaaacaacgcacgacaaacttgtgaagttggtgctcgatgataaagttagacgaaatgttgtatctcttattgttttgcgacaaatttacatgtcacggctgagttatatgcttaagggaagatgaaaagttcagtcaatttacatgtcaccactgagttatacgttccaggaaagacgaaaggttcgatagaattacattacggttgagttatatgcttaagggagaacgaaacgttcagtcaatttacatgtcacggctgagttatatgttccagggaagacgaaaggttcggtaaaattacattacggatgagttatatgtttaagggaagacatctataaatttacatgtcacggctgagttatatgttcaagggcaaacgaaagatgagtgtaaattatatgttacggctgagttatatgcttcaaggaagacgaaaggttcggtaaattacatgtcacggctgagttatcattcagggaagacgaaaggttgtgtaaattatatgttacggctgaggtacatcacgttaaggctgagttataatacagatcggaaaacaacatttttctggggaagacaatatgaaatttattggccaaagaacaacaatcaaattaagaaacgtaagaatatgtttgagggatacataggaggaagacgaaactatatgaatcaaaacattgatagaagtagaaatatctctaaatagatcgattgagaggaaaactaaacgagagacatataaaatcaaagtaaaagagtagttattcttgattcaactcaaacctgtaacaaatcatataaaattctatagatc

SEQ ID NO: 94 - DNA, 1753 bp, Artificial Sequence
  sequence of STAR A10
gatctgaatgagatgtgttggcgaacgcatatagtttttgtttcttgctgttcataactttgcttatggaattttatttatgtctttctctatacctctttggaccagtgttccatttgcaatagagagtcactcgtgaaaaaaacaaataatgtgtgtgtatcaattattccctctcggccttatattttgtcttctttttgctaattatatactattgatttagatatttacttatattcatgacgtcttcttcttatattcttatttaatttgaagttagaaaattaacgttacaacttacaactattaaattattgttaattggttttataataagtatcgctcttgtctccattcacttgtcttttattgtccccagtaccaaactaccaaatacaattcatattcactaattaattagtttgatgcaaaggatgatgcaatgttaagaaaattgaaactctaccacattctaaaatgaagcaactctaccatatttaatttctttagacttggaatagtcacaatatgaatgcttaggtagttacggttagttaggagtatcacacagaattgaaaataccaaaccacaattttaatcaggtgattcggtactaatttttattaatgaataaaaacataaccgaaccaactcaaagcagatattaacctgaaaatgaactcaccaaaacaataatagaaagactcaaatcgagccggaaaccagattgagcaacgaactcatgggaatatcatatctatttatgtccagactattaatatacatacctatgacaaaatactatgcatgcaatgcaagactgaagtaaccatatttttttgggtaaaccattgataagctaaacttgaatatccatagtacttcatcgtactatgtatcaatagtatagtaagtttgacacaattacattcagtttgatttttatcatataaacctcccaacaatatttaaaaccgtatctatatataaatttatttgattaaatcagcctagaagtttatagttcagtgcagataaattcaaattttgatatatatcttaattgaattaaccgtcttttggttaaattattgttacaagcttacaaaatccactatacaccaagttggacttagatatcatatatgagattaacagccgattacacttgtacattgacctgacctatacaaacgactacaactttatgtatatatatttctctatttttggaaactcgtttgatttgttttcacatgtcgtgaaatttacagctttgtttcctactctcaaaaatagagcatagagctggctgatcacacttcaaattaaaaccaacaacgtatataaactataacccatgtgaacacaaaaatttagaccttttttcaaaaccattccaatttctaacaaaaacaaaattagaaatcctaaaatctgcaaggtgtatggaaggcaaaaaaggctaacaggattaaaaacagtttacattagttattctctttaaaatagaaagaagattttcgataaaaacgtcgtcgtatcttcgtcgacgtctccgtctttaatgggggagcaaagggcaagcggtgcttcctcctccaccgactcatattcaactccttcgccgtctgcgtcaccgtctccatctccggctccacgtcaacatgtcacgttactcgaaccatctcatcaacacaagaagaaaagcaaaaaagtcttccgagtttttcgttcggttttccgatc

SEQ ID NO: 95 - DNA, 1908 bp, Artificial Sequence
  sequence of STAR A11
gatctcactcaagctcatgctcacgttcaaggactttccaaccgcaaggttatcttcaacttgtactcattaaggcctctcaatattcatgtgttatgttcatgtagatgtccggtccagttcaacaactgtttcattgctttagttgtcacgagaaatatttgtatatattattatggtgtgcaaaacatagtaaaatgttgttcaattggcagatgatgatgatgaaaatggaaagtgaatgggttggagcaaatggagaagcagagaaggcaaagacgaagggtttaggactacatgaagagttaaggactgttccttcgggacctgacccgttgcaccatcatgtgaacccaccaagacagccaagaaacaactttcagctcccttgacctaatctcttgttgctttaaattatttcatattgtaaattactttctgctttatcggttttaccatttcgggagtcttttttgtgtgcaatctgtttcgtttggtaagcttgtagtttcatgaaagtgaatgtaagatatgcattacgtttgttgctgaagtgaatgtaagatacgcactattatatctcatgattttctaagaaaaccctcttaaaacgaagatgtctatagcattacgtttctatttccatataatacgttaaaatttatggtttttacgtataaaatgcaaaataaagacacaagtatatctccaaagcaatgtaccgttgggaaaatttattagtacgttttcaattgtcaatgcaaataattaatggatgtgatagtcacaattaaacatacaataataaaaatgatgatgatgattcgatgatgtggtgggaaggataaattaaaccgactttggggcagtgacaggcagtgtcagtgtcaaagacaaccatttgtagtcactatttctatcgaaggttgcaaattgaatggtggaggagtatcaaaacgacacacatacttgaaaagatattttaataatataaaaaaattggtgatggcgtaataacaaacctagagctaattattatccttaatgataccaaatctatatgatacgatatttgttttaaaaagagtaaagactgacacttgagatgtgacactggcgatttcgctcacgtcaccacttttcccacctcaaataacgcttacggctttatccattaattctaagtataattttaagtgtattttttcttgccaaattcaaatatatcttactaaatggatgaacattataaaattgttatcaaaaccattaaatgttcttataatttctttcgttcctccaatgtcatcccaagactttttgacctaatatatgatatatctaacttgctttggaatcgtatgacatatatcttcaaatacatatttcgtatttttttttcacgaaaactaatttagaaagtagaaaaccagctattttaaagaaaataaagtgtgtttatatatattctaaaacaatgctataagaacataagaccaagatatatacaatgttattttatatttattattaagcattaacattgaaattaaaaatattaaacatgtataccaaagtaatcaacattgtagttattactactctctctgttcatttttgtttgattgtttagaaaaaacacacatattaagaaaacatattaaatattgattataaatgtattatttttaatgttttacagttttctataactttaaaccaatgataattaactatttttttaaaaaattaccattcacctatactaaccaataaagattacatagaaaactaaaaaaattaatcttttaaaaacaaattttttttctaaacaatcaaacaaaaaggaacagagggggaatattattttaatttaatttagattaccattgtagttagtaattgatc

SEQ ID NO: 96 - DNA, 1403 bp, Artificial Sequence
  sequence of STAR A12
gatctattgctgtttatggcaggctgtcatttcagaaaagaatggtggtttgggatgtaatgttggtgaagatggtggtcttgctccagatatctcgaggtacatatatttttcctctctgatgctaatctgcttgcatctgtagattgtcgaaactgagaaaaccatgttatggtttgatggcttagtgcctaatatgtgtaattgcaactgtatgcagcctcaaggaaggtttggagcttgtaaaagaagctatcaaccgaacagggtacaatgataagataaagatagccattgatattgccgccactaatttttgtttaggtaattttctgcttcctggctaactgattttttgcggcttcttgtagtcatggatagtcttggtttggttctcggcattgtcattcacaattggctagtgagacgaataagatgttaaatcatcaaatgtgtagcctatcaatatcttgctcttgcaagtttcaactatgttatacgtttttgtgtattatttcttaccttgtggaactgttctttcctgaacaggtaccaagtatgatttagatatcaagtctccaaataaatctgggcaaaatttcaagtcagcggaagatatgatagatatgtacaaagaaatttgtaatggtatgtctggctcgtctgaacaatattttttgtgtctatcttagtactcttgcagtattgtaacgaccagattctctgtttggtctccttgtgggtttagattatccaattgtgtctatagaagacccttttgacaaggaggactgggaacacaccaagtatttttcgagtcttggaatatgtcaggtccaactcggttcccctactattaacggttcacatagattttgtgttctttcagatcacactgtcttctgattcttttctcagagtcaaatatctaaagagagagacccttaaatcttcttgtacaatcattttccttgtctaaattctcagtgttaaactcttgtaggtggtaggtgacgatttgttgatgtcaaattcaaaacgagttgagcgtgccatacaggagtcttcttgtaatgctcttcttctcaaggtatttcgtccgtcctattttgtttattactatgtattacctgtgcacatattgtatgtttactgcctaagaacgacaaagacataatgtgcatacggtgatacaggtgaatcagattggtacagtaacagaagccattgaagtagtgaaaatggcaagggatgcccagtggggtgtggtgacatctcatagatgtggagaaacagaggactctttcatctctgacttatctgtgggtctcgcaacaggtgtgattaaagctggtgctccttgcagaggagaacgtactatgaagtataaccaggtctggatc

SEQ ID NO: 97 - DNA, 1140 bp, Artificial Sequence
  sequence of STAR A13
gatccatttcatatacatattaccaattttggcttttataggtttgtatccagaaggccttttcgtggctacgattaaggaaaatacgaaaacaaaagtgaattttactacttttgtagcatggtttattctactttatatacctaagaaatatgagcaacaattacttctgtaatgactttttactacttcgtagttggtacaaactacaaaagattgtgttgtttttacatgatactttataatatctatattaatatatttagtcgtgtttaatcaaaaaagcaccagtggtctagtggtagaatagtaccctgccacggtacagacccgggttcgattcccggctggtgcattgagctatgatgatataggcttcagcattggttgggtccattgcattcttctgaactatcagttgatgtatgccacacctctgagctcttctttttttttcctcgtcaattaattttttaaagttttgtctgcctaaaaactttcttctttttgattaatcatattaagcatctcggctataaaaaccacggtctactaacttaacatgcattggactagttttagtggagagtgttcgagttaaaatgagaagctcacgattgcataacggaacatttgattcgctaggcatctccatttgtaaaagtagccactccaatacaaaatggtcgatgatggtgagtgggtgagacaaacccaccaccacctcaagaagatatatttctctggttaagaatttgaatggttgacaaagaaacggtcactctatatacttagaaaatatagtcatacatagacaccatcggtctagttataataataaccactggattaatgcccagtgaaaataattgagtagccaaaacatgaatataacaatatcccaatttacatacaacaacacaaaggaggttttacacgattctatagtacaaactcataacaacaaaaaatcacacttttgtttaacagttgcctttatggctttactacagtatcttgtccagggttttcacacataacaatcacagtaaatcgtttccttttctttgcatcttccattccttttgtacacgtaacatctccggcttcccgaccatcagctaagaaccagatgcgatc

SEQ ID NO: 98 - DNA, 2125 bp, Artificial Sequence
  sequence of STAR A14
gatccagcaactaagtcttatgctcaagtgtttgctccccaccatggatgggctatacggaaagctgtttctcttgggatgtatgctcttcccacaagggctcacctacttaatatgctcaaagaggatggtgagttcatcaactagttaatatgctcaaagtggatggtgtgtttgataaactagtagtttaagtagtcagattagtttcaaggtcttcacaggattaggtagatatcacggcaatatttggcctgtataagtcctggtatcataagagagaactctttgagattcacattggttttaagttcatttggcagtaggatattagattttgaattttccaatactatctctgtttgagatttcataaatcgagtttcttcttcattatgttcgctgacgatattgtttttttcatttatttatgaatgttgttacagaggcggcggctaagatacatatgcaaagctatgtcaattcatcggcaccattaatcacgtatcttgataatctattcctctccaagcaactcggtattgattggtgaagagcctgaaaaaaaggcataactattgttactctttagacaaaataacctatgttctcacatcaagctatgtaatgtcataacaacagcgacgaaatacattggaataaattgagtatgtccttaatctgtcgttttatctcttcttttaataaacacagtttatctcatagtaagcagaagaagctttacacgggttgtaggaacgtattaaacggtttgtttcaatttcactctctttggttttgaaattctagtataaaccaaagtagttggtgcttcaagttgtgttacttattcaacaaaaaaatatattatttttaatttttaattttcgtaggtaagattacatagtaacaaaatgttaaatttaacaatgtaagattactatgtaaatgcatgggcaccagtaatcacgtatcttgatgatatatatccctaatccaagcgagtcggcatttattggtgaagaatctcaagactcatagtcatcgctagttaacaatctttttcggacaaaagcgtcttcgttaaaattcggcattattaacctttttgcccttttaaaatcagaaaatttctgttttactggtatttttctttgacgattcaattttttagttgtattatatatatgaaagaagcttaactctctctcacagcttgatatgtcagtatctaaaacaagcaatacataatttaattaatttatcataaaatatttatgattaaaaagtaaagaagataaatattaaaaagctaaatgtctcttataatttaaaaataaaaattaaaaaggattgaaaagtaaagaagataaatataaagaaactattagtatcttataaataaataaataaactaaaaattgaaatataattattttagttttgaattaagaaaatattaaatataaaaaaaattaaacataaagaaactatatatatcttgtaattaaaaaattaaaaaaaaatgaaaaatgagaaaaaaaatataaactcttcatcatataattaatgaaatttaaaaacttattgcttttaattttttgtacaataattaaggaaatttagaaattaattattaattttagaagaaaaatgttaaaatagtttaatagttttgattcactaaatacatgtgtacatatatgatggtatgaggatcaagaaagtgccgtaaaatgtaaaacttccaatgttccttagtgaaaaatgttaacttttctgttgacaagacgtgtatataaacatcacctataccggagaagaagaagacacaaaacaaagttaaaaagaagaaatttttggtgcagtgaattcgaagagcaatatgaagaatattggttacattattatagccaccttgcttgttggtctcctcctcatcatggctctagtggcgagtttctattgggccaaacgacatgtcaaatgttgtggcggagagggactgtcgtcaaaggatgtgttcaatttacttatacaattggttgcttttattctgctttgtggtttatttgcttatttggtatttttggtttagattagtaacctaaagccatagcagatc

SEQ ID NO: 99 - DNA, 1196 bp, Artificial Sequence
  sequence of STAR A15
gatcagcaattacagttggatggaaaaagagagacgagaatgtatctgctgctggtgactttaaggtaggctgagtaccaaattgcattctgactgttcttacctcgaccacctttcttactttccctagctctaatcttgctattactagattgaatctggtggactcggagcatcagctcgttatactcgtaaactttcatccaaatctcatggtcgcattgtgggtagaatcggaaggtatgttttattgacaatcccgagcaacctaatgtatgatgtgcgagaggatagaaatcattttttaagttgtctttacatgtgtggcgcaatcattgttctcattttactttggaattttttttttaacttattcagcaatgctcttgagattgagctcggtggtggaaggcaaatttctgagttcagtacagtaagaatgatgtatacagtaggactcaaggtaaactactctttaaaactttcggagccatcttagccattatgcaatctgcttatttccggtactcttatactttgtttgtagggtattttctggaaagtagagctacaccgtggtagccaaaagctgattgttcccgtgagtgttactttcttcctttcttttcttgtggtgtcatgtctgctgtcttcggataagaaccgaacagattgtgtcttaatctgtggagtagaatatattaaaaaagcataaaccaatagaaccaaagaccaatcctaaaagcctagggatggattctagagcattatccttgactctctgaaacctttacccaactcaattatggacaaagacaaacatccgtattactctggggaagtctttcacttttgacaccttcatgatgattatctttgaaacgtgcagattctactctccgcacatttagctccagtatttgcaactggagcattcattgttccaacatctctttactttttgttaaaggtgagtgattggaccctctaaatataatctacttttggtctattgttataagctgtttaccttattaaacattttcactgttccacgcagaaatttgtggtgaagccatatttgcttaaaagagaaaaacaaaaggccttggagaatatggagaaaacttggggccaggtgattgttacttccgagtttggtagccaagcgagattccttgtaattgtagatgatc

SEQ ID NO: 100 - DNA, 692 bp, Artificial Sequence
  sequence of STAR A16
gatcgctttcagtctatcatgttttgagccttattttgggagcgatgtattaatattttgcctgttctttattttttgtgttgcagacatacaatgaagtgcagcggtgttttctgactgttggcttggtttaccctgaggatttgtttacatttcttcttaacgtaaggacatcttttgttttatgattatggctctagttattctttgtatatgtaacgcaaaacggtggcaatacctagcactcatattagactcaagaactattccttgccacacatctgtgtgatatttatatgggctttttatcttacatatttgaaatccctgtcttccttgtatactttcaccagaaatgcaagttgaaagaagaccctttgacgtttggtgctctttgcatcttgaaacatctgcttccgaggtgtattcttttatccttcatcagtataacttatcattcagagttaatttaccatcctaacttaatgatgttgcattgtgttcgaaggttgtttgaagcatggcactcaaaacggcctcttttggtggatactgcaagttctttgttagatgagcaaagtttagctgttcgaaaagccctttcagaggtactgagctggcgtagattttcttatttactactaaaatatgcatgctttagcatagtgcttctactttaatgacagttgatc

SEQ ID NO: 101 - DNA, 1826 bp, Artificial Sequence
  sequence of STAR A17
gatcacgataattttccttaattatctaattctaagatagtctaaccatgaatattcttataatatcttaactgtataggagattctattttcatccctaaattatattcgtaattttattcggatatacttgcttttattttcgtcaacagatatatatatatatatatatatatattatttatttttaattttcattaaaattagtgatttaattctctattatttgtgtactatataaaacaaacaaatgaatcttataatgtttgctttttcgtccataaatatttccgggaaaaatcgttagatataaatcgaacctagtggtgagtgactcacacacatgtgacaattcccaaaataagtcccccacgtacgctatgtctgttttagtgtgcatgtagtaactattatttactgatttagaatataactagcatttggcccctatttagggataacattgttttagattatatctgttacaacttttaactaaaaattttaaaataaagcagacagtattaatatacaacaaatttattatcattgatcgaagaatatacaaagattaagaaaaagatataaagaaggtacaacttttctacccaatgaatcaattgcgataggcaataactaacaaatcaagagtttagaaatataagagagtataagtacgaaaattatgctgggtatatacatgtccgcttatttcatcattagctccaaccaattgtaatgtgttcttcttctcatcatcagtaattcagtttacaaacattcgttgacacccaaagcttggaagtctaaaaaaaaatgtaaaatgtgcacaaataagtaactacatgacgcagacgctgcctttgaaacaatatcaaagatattgcagatataaagaagtaaaataagagatgactttaaaattgaagtatttgtattaatacaaaaatcttgcgtgaaaatacaattgcagtttaatacaaaaaagaaattgcagatataaagaagtaaaataagagatgaaagaagaatagtaaaaagtatgagaattaatttaccatcaaaaaaacacttgagcttcgattaagatattaaactcacccttgttttaaggcaactgttcagatgagaagccaaaatttgtcgttgttccttgagtgtttgtgagacgggagaatcataggcattgattgtattaaagaataatcctatggaaaaatggagatgtatgagagaaatcgaattcagtcaaataaagcagaaacaaagcaaaaaaaaaaaaaaaccatagaaatctagaagaaggatatatgattttcggatctatggaaaatttctatatatataaaacaaaattacaaacagaaatagaagatggtaaattggttcattgagatgaacaaagtacctgatttctgagtaatcgattaatgatgttgagaaacccatttttgagattttacacagtagtcatggagtttttggaagagagaaagtggagatgtggagatcgtggggatgaaagagaaaatcatttgagaaagaaacaaagttaaataaaaacgacacatactatgcgtaaaaatgaaaaaataaaaaatagtactaagctgatgtgtcaatcactgaatgcattagttattggaaaagtgactgctgatttagtatatttagattagagaaaataaatacttgtaatcatttttcttattagcaatgttgaagtgaaaaaaaaaagaagaaaaaagtgtatatttatcatactcatagtgggaaattgataattcaaaattgctgataaacgttatgaaagaaggtggaggatc

SEQ ID NO: 102 - DNA, 1590 bp, Artificial Sequence
  sequence of STAR A18
gatctgttgattggttaaatcgacgatctcaacggcggaggaagtgacgatgaaggcgcggcagagaggacaattagagtgagatttcaaccaagtatcaatacaaggaacgtgaaacgcgtggttgcatttaggtaacaatctcaagctctcgttctcttgaaactcgcttaaacaaacagagcaatctgaagattcaacaaatccatccatctttctgtatttgtaaacagttatcgatttaatcagagattcatcgagtccatcgccaccaccaccaccaatcgtttgattcggattcgtagctccgttgttgttgttgttgttggttccttgccaggtgtaatctgatgagattctgtttatagctgcggcggaggtagaggaggagttgtggcgacggcggtggcagtatttggagatgagagtgtagtagctgacgaggatgaaggcgctagcgaggattccgatgagagcgatgaggagaggagagaaatcagaggaggaagagtcgtcttcgtcgtcgagatagaaggaaggaggaggagggaagatgacgtaacaccattgagggcaatagacactgcatactccttgagaacagtctctgtatgaatcgtatgttgtaccccatggattagggtttcctgttgaacccattatttgattgttggagaaagatagagagagagagcaaggaagaagatggaggtgtcaagtgtctctctcctttttctttgggctctgcttttgtctggtaagtgtctatttttttatttcgagttaattggtattattagaggagataatgaataaatatatatgttcatgaaagcttttgcatgatggtgttaatactaattgaatgatgtttatagtgaatgttctactttatcaaatttttatttctagtatgaataaaggtgtagaatttgctttattcatttttattctttagctttctctttatgcttccattttttttaaagataaattaatacattagtaaaataaatggagttcattttttttttttttgattttattttgagaaatgagaacgtaacataagaagtgttttagtgttgacgaaataaaaagagagagagggtttagtctatttcaaggcataaaaaaatggttggtgaagtgttgacgaaggtggaatactataacatgggccacgtggatgacaaatttactcctcgacgtatctattaaagttgtggtcagaaatacagtacaatttaccgactacctacatggaagaagaatattttcatttcatttcaactacagtagtataacattcacgttatacgatttttcatttttgttttgtaatcaaagtaatgattttccaaaaaaatcattgctatgattcgaatacatacagttttatattagtttacatatttatgacaactataatacaaaattttaatagttgttcaagggacgattgatgtgaactcgccaaccatatgccctacgtacaaaataacatatttacatgtagaagttgaaaataataataataaagtgtgattaaaaacaattatacaaatgctaacaataggctacgagatc

SEQ ID NO: 103 - DNA, 706 bp, Artificial Sequence
  sequence of STAR A19
gatcttgatgtgtgttttgtgtttttgttattgcaggatgtatgtttcatagtgagacagggcttaagagctttgaccatccgactaatatgatgaaggcaatgccgaggattgatagtgaaggtgttctttgtggagctagtttcaaagttgatgcttgttctaagatcaatagtatccctagaagaggaagtgaagctaactgggcgctggctaattctcgttgattttgcttctagtttcgttaactcttgcttctttgttgcgttttctttttatgtactcttgtttatgtaaatatagccttatgaagacgataaagaaataaaattgatttgcttcttcgtgacatagcagtctttacttagacaactgtgtgataaattcgcaatctcactctttgatagataagagggagggaagaaagcagtggtaaagacaaaactgtgttgattttgtgaatttagaagtttacaatagcaaaaaagaaactttggtcgacttttatcattcatcgttccacatgtctgtaaattcatcaggctccaatgggtttgagagttcatgcatctttcttcttgtttttgcctttattttcttagcaaatttcccagctttatttcttttctccaaagctcgaatctaaaaggcaggaaattggaatatatgagaactctgacagataatcatatatagcaatgtgatc

SEQ ID NO: 104 - DNA, 2064 bp, Artificial Sequence
  sequence of STAR A20
atcgtttcaaagcatggtctaatgatgatcctgatctccgactgatccaataacggttaagcaacgctgtttttgatcctccattgttgtttgccatcgatcaacactcagaaataaggtaattaacgcatctcgagactcattgttttaacaatctttgttttgtttcttccaaattattctcgtgaatatccgtaatctctccgtcttttaatgaacaacacatatcatatgcttttgtttgttttgttttgttttttcaacatttcaataattttgtctttttttcttcgatttaatttgtttatttcctgctataataaacgaaaactataattccatgtaatgttcgttgttgttcatagtgatttatcataacgagcaacaacataaaaatcaagagaataagaaattagagttatgctgcttatttgaattagacaaaacctacttttacttgttaaggaaatgaaaagatgttaataaagatgagcacatcgtacgtggcgcacgtggaagcacttctgtacgacggacccagtccaactcgaaccccacacacatagcaaaggttgttaagttggctcgtaggtgaatttaatacctgttatttcctttatagctggctaattacctaaattcgatccataataacacattcctactatgccaacatttaaccctagtcaaactaattaaaacgtttcttactttttggcctattaaaacgtttcattatgttccgcaaatagtatgaaatatataaagattttctaacaaaaaattactaagaacagttagactgattgagattgtttttatttccttttatttaattttcttttattatactctgtttatttgtgtttaataattaggattctatttgtcttgtcttgtttgctatagttggagttttgttcataaagaatggcgtttaatacggctatggcgtctacatctccagcggcggcaaatgacgttttaagagaacatattggcctccgtagatcgttgtccggtcaagatctcgtcttaaaaggcggtggtatacggagatcgagttccgacaatcacttgtgttgtcgctccggtaataataataatcgcattcttgctgtgtctgttcgtccggggatgaaaacgagtcgatctgtgggagtgttctcgtttcagatatcgagttctataatcccaagtccgataaaaacgttgctatttgaaacggacacgtctcaagacgagcaagagagcgatgagattgagattgagacagagccaaatctagatggagccaagaaggcaaattgggtcgagaggctgcttgagataaggagacagtggaagagagagcaaaaaacagagagtggaaacagtgacgttgcagaggaaagtgttgacgttacgtgtggttgtgaagaagaagaaggttgcattgcgaattacggatctgtaaatggtgattggggacgagaatcgttctctagattgcttgtgaaggtttcttggtctgaggctaaaaagctttctcagttagcttatttgtgtaacttggcttacacgatacctgagatcaagggtgaggatttgagaagaaactatgggttaaagtttgtgacatcttcattggaaaagaaagctaaagcagcgatacttagagagaaactagagcaagatccaacacatgtccctgttattacatccccggatttagaatccgagaagcagtctcaacgatcagcttcatcttctgcttctgcttacaagattgctgcttcagctgcgtcttacattcactcttgcaaagagtatgatctttcagaaccaatttataaatcagctgctgctgctcaggctgcagcgtctaccatgaccgcggtggttgctgcgggtgaggaggagaagctagaagcggcaagggagttacagtcgctacaatcatctccttgtgagtggtttgtttgtgatgatccaaacacatacactaggtgctttgtgattcaggtaatatgtgttcaaagttactactttcaagcaaatcctctgtttcctcacatcatgatc

SEQ ID NO: 105 - DNA, 1834 bp, Artificial Sequence
  sequence of STAR A21
gatcttcttctatatataccggtataagtcaactggcggctgaacaaaggtcgtgaggtaacaaaatatgagacaaatctacaggtcagattgggttctgaattctgataaggtcttaaaaaggagctcaccaacccacaaaaccatggattgaacaagtacaggtcattgccttcattttattctttacttttctaaggctcaagcttcctttattgcctttaataacaatatactaatgagtattttgcactcagtaacaaaattcaggagagtaattttttgccctaacatgttacttttatgtgttaagagtttagaattttggatctatgattttagtttttgttagggaatcatattcatataaataaaatattgccattgacttaattgttgttattcacctaatttctctccaaatttggtcatttacctcagttgattctatattatacttgctaagtgttctttgtctaattctctatcattgtttgatttaataataaccaaaccttaagacttggaagcaaagaagagagaaaatcccaattaatttttaataattcaaagagagatattgagtgacttccactaatacaaagaaagcttggtttgtgcaatattttgcggttaagctattaattgctgaggcaacaccttttcacactttgctttccttcttccaagttttcaacttttctttcttactctttctattaatcaaactgcaacacaaaaatcatttggataatacatgtttagaagatgattaagctttagttttatttcaagattatcataattgttatctgttgttacctacattcatataatcttatcaaaaacgataaagacaaaaaggggatacaatataggtttttattataaagaaacaggaaagaaagaaaagggttttcaccaaacgaaattagttcaatcatttaaattatctttatccttatgattagtgtctttatatctgtcatatgctgcttctccttccaacttcctttggattatattctcttctctttattttaatttccatttgtggtagctgttttattttttgtattttcacgccgtgtccctttaaaataatattaactacaccactaatgttggaacatgaaaaacatgaatgaggtaattatgatgatgaaccaaatgttaaggacaagctcggtgtaactaagaagataattagtgaaacagaacaagtcaataacttgtaagcatttcagaattgaaaataaagataagggaggatgaatatgaatttagtaaatgggtaatgaaagtgaaagaagaagagggaagggttggttactgtctcaagggtttgaaatggagacggttgcttgagaatgaggaaaaagagttagtaagtttttaactctctctttctctctccctctctctttttcaacgtcaattcctttaaggaatggcctctctctctctctgaaagtgtgtgtgtatatattaaacgactccatttctcctctgcttagaccaaaactcatcttctatactgcaacaaagaaggaggagccgttgagactacaaaatgactgcagcagaaaacccttttgtatctgacacctcttctctgcaaagccagcttaaaggttcttatttttctttctgtttattgttcatcaacccttatgagtaatttgcttgatgttgaggttgttctgctttcttttaattccactctgcagaaaaagagaaagagcttttggctgctaaagctgaagttgaggctttgagaacaaatgaagagctcaaagacagagtctttaaggaggtaacatgcatgatgatc

SEQ ID NO: 106 - DNA, 751 bp, Artificial Sequence
  sequence of STAR A22
gatccattaagaagcagccgcaaaatcggattgagaacaggaaaagaggcggttaaggcttatgatgaagtcgttgatgggatggttgaaaaccattgtgcccttagctattgttcaactaaggagcactcggagactcgtggtttgcgtgggagtgaagaaacttggttcgatttaagaaagagacgaaggagtaatgaagattctatgtgtcaagaagttgaaatgcagaagacggttactggagaagagacagtatgtgatgtgtttggtttgtttgagtttgaggatttgggaagtgattatttggagacgttattatcttctttttgacagaaatacattgaaaactaccgttgctaatttgataggtatacatatatagacatgtatatattgtataattatatgtcaagattatttatttattttacatttttcacaaaaaaaaacgttaatctatttttctgtcacaagtgtgtttttattcatactacatactacaacgccaatttaacatgccaaatataaaacatacatgggcaaaggcccaacagccagtttaaagaactttgtctgaagagaaagttgttgtatatatcacaagggatatgtggtaattgggaaacatgttgggttgacacgtgggaaattgaaggagatggagtttccgtcactggtagaatcttctaacactagagagcttcaattcaggttgaaatcgtcagaaaactaatgcagacggtagatc

SEQ ID NO: 107 - DNA, 653 bp, Artificial Sequence
  sequence of STAR A23
gatcaaaacttagtcaaatcgttccttccattttctttcagtttgattccactttaatggcgtcataatcatctcttaaatcaaacaatgactccactatctcgtttccgatctcttgttacataaagttttctgtagcattgagattgtccttttcggaattgcttttatttgcgcagcttgatggaaacaacaaacagtgtagtagtttagtagaaagactgagagataaaacgaagagtcaagttcctaagtccattacttgcattaaccgcttagagatatcgcgtatagcaccattacacgcaacgatgaatagcccgaaaggatttggacctcctcctaagaaaaccaagaagtcgaaaaagccaaaacccggaaaccaaagtgatgaagacgacgacgatgaagacgaagatgatgatgatgaagaagatgaacgtgagagaggtgtaattccagagatagtgaccaacagaatgataagcagaatgggatttacagtggggttaccactcttcattggtcttttgttcttcccattcttttactatctcaaagtgggattgaaagttgatgtgcctacatgggttccgtttattgtttcgttcgtcttctttggtacggctttagctggtgtgagctatgggatc

SEQ ID NO: 108 - DNA, 548 bp, Artificial Sequence
  sequence of STAR A24
gatcagactgaactcgtgtactctgagccttgcttcttgtagctcttttagctttcacattttcatcagtattcacatcattcctgataattgtgccagaagtcccacgactatcttgttgctcactaatggttgctgctgcagatgattccatgttgtcctcttgtgaaaccccaatgcttcgtctagcaactgtatttcttgcacttcctgctttgcggtttttacatttggatgatgcaactttaactttaggtagcttcttttgagtaagatcaatctcatctctacctaggacctgcaaatcgatgaaatttgagttcatttcaacacacttgatgacactatcatagaaaacaaaaagaccttgctgtaccagagtgaagaacagcctttaccttggccttcacaggactaggtagaatctccggagaacaaggcctctgagtccattcaaacatttcgctatcaaacatgtcacctggattgggcttttgttgctcgtcttcctgaaacattcatcggaaaaaaagtaagatcaaaggatc

SEQ ID NO: 109 - DNA, 1000 bp, Artificial Sequence
  sequence of STAR A25
gatccaaactctgcaatgtatattacgaagtcgtttgatataacacctctcttgataaaagatgattagaacctaaagtaattttaaaatatggtgaaaaattagactcttggagtatataaatggctcaatctgtattgcccgcaccgcccaaactcccatggcaaatccattgacgaaaccaaggtaaaaatcacatgctttgagcgtttttttaaaacagaagtgtaagcttaaattttttagtttaatagtagtaacaaattcaaccttgtgaagagatttattaataatattaaaatcattcccctaattatttgccttgagtttcgagccttctactgtaccactcacacattaaaaatcatcagactattcaaactttcttacatggttgattagttcatctcatatatgctcagtatcatactcttgcagattaatttttcattttaattatcaacgaattttttatttaattattcatgaccaaaatacatttattttttttaaataaaacaaataataaatttggaagtcaaaaatacaatcaatagaaaaaaaagtatgacagtgatagataatatttgcagaatattatgtgaaagctattttctctgtaacaataaatgagaaaatctttattattttacatgaaagaaaaagaaaacaaaacagagatatttttccagctgaaaagaacaaacatctctcattgatgttcagtgaacttgcaccaaacttcacttcttctatacttcttcatagccacaaactcagttctttgcaagaaacacaaacttaagtattcaaaatatcgtcatcatgttctcaagattccatgctctgtttcttctccttgttctttcagtaagaacatataaatgtgtatcttcatcttcttcttcttcttcttctttctcattctcttcattttcttcttcgtcttcttctcaaactcttgtcttgcctctaaagacccgaataaccccaacggatc

SEQ ID NO: 110 - DNA, 1926 bp, Artificial Sequence
  sequence of STAR A26
gatcctcgattcttatctggatacagaagaaaacacctttttgtcttttaagtactcggagaaatctgagggtatctttttcttgagcagatggaggtgaagtcctgagttggggaggagggggctctggaagacttggccacggtcaccagtccagtctttttggcatcttaagaagtaacaggtttgttttacttaatttcaatatcgttttgtctctttctcatgcattttttgctcacaagaattttcccatttcctcctttactttatcatgattccttcataattttcttgtattgcactgtaaagtatccccctgattgcagtgagtttactccaaggcttatcaaggaacttgaggggatcaaggtaatctagtggtgaagaatatccaccttggatgaagagtttctagttacctagtggtggttttaatctttagactttcatgcttatgtttttccattctttctgtcgagcactaggtcacaaatgttgctgctggtctgctgcattcagcatgcactgatggtattgatttactttcttaaaagtatgaatgttgtgccatttaccgaactttatgaggtttgtttgcaaatgcagagaatggctctgctttcatgttcggagagaaatctataaacaagatggtaagaaaatgtctttttctttgatttctgtggtcatatatgtgaagctatctgatgggaaaatacagggctttggaggagtaagaaatgccacaacaccatcgattatcagtgaagtaccatatgcagaagaagttgcatgtggtggctaccacacatgtgtagttacaagtaatactctcttattatatcgttctttctttgatattgagtttgcttgtatactgcaaatgcctgtcctgctcaaatttctttttgttattctttatagaggcccaaaactgctctttagtttctgctaaatttatgaacatattgtgtttgtaagatggtcgataacaactcatcgtttgatgtttccttcgtttttggaaggaggtggggagctttacacctggggctcaaacgaaaatgggtgccttggaacagagtaagttacataccccgaaaaaatagaatgtttccccataagatgaaaacaaggttcttgaactgtacctatactcttatttcaaaaaattcagttcaacgtatgtctcacactcccctgtgagagttgaaggtcctttcttggagtctactgtatctcaggtatcttgtgggtggaagcacactgcagctatttcaggtagcatctcttttgagtaaaacatatttgtttcctctctcattgtataagttaattcaactcaatttctgaaacttgtttgcagataacaatgtcttcacctggggctggggaggatctcacggcacattctctgttgatggacattcctctggtggacaattggtttgtttcatcatcttatcttattgatcaaatctctgaaacaacattttcaagtgtcgaagagaataaatatggtatgcttaatatgtagggccatggtagtgatgtagactatgcaagaccagcaatggtggacttgggaaagaatgtaagagcagtgcatatatcttgtggcttcaatcatacagcagcagttcttgaacatttttgaagactcggtctcaagttaatatcatatacagatgtttagtttattcttgcttaaacatctatagactaaaaaaataataagaaatttacactattgaatagcgatcaattacaccattggttctaacttgaacaatttagtaaataggtggaatattcttgtcgtgtaaattattgattttatttatttatttttgaaaactacaacaaacgatagaagagttgaggaaatctctttgtaatcataattatgagaaaattaagatc

SEQ ID NO: 111 - DNA, 1109 bp, Artificial Sequence
  sequence of STAR A27
gatcggaatcattttgggagtttgaaggaactaaacataatatgcatgtcgaagtcaacttattgcaaataattttgaaatgattctgaattggaaattcatgaagcttaattattttatctaaataagtttaatataggtttgagtgagatatcgagattaaatgataagagtctttcttcgaggagacattagaattctacacaaaaatcgaaattaatctagtccttgacaatcagttttcaattaatcaaaaacctataaaattcaactcaaaaccaatcgtatgaaacttcattataccatataatctggttacttagcttaaatctctacccggcgatgtttcatgcttgagagactaggtacataggacactaggagtactgcatatatggttacctcatgagttctcatcgtaaaatcatccaataaaaaatggtttcctgcttaggtatacggtataccatcttgtatcgttaaaatttatagctcagttcgttgctaacagtcaaatacgtctttccagggtaaaaaatgtggaaatttgttccactgtaaaaacctaataatttttgacattaataattaaaagggattataatgtaatatatacaaagataggggagacagagacgaaggcccacacatctttaacaaaagaacaacaagcccgtgaccccaaaataaaactagctttcagatttattatttttcatctgacataattgcaaccgttagatttcatttctcaggtcccattctgactcagatccaaccgtccatattcctctagtgtcttcaatagttgggccccttttctttttcctctcgccgtacactctccttccagcgccaacgccaccgcccgagccacttcttccgccggcgccaccgcgatttcctcgccggaatcccctccttcgccgcctttcccgtagaccacggaaaggatgcttatggcgtattctctccctctaccagccaatctcgccatcaccgctaccatcgccggcaccgtcatcgcgtgagcgcgaacctccgccgctccttctgccgttgtacacattagctcaagagcagctaaggctcgctccaccgctgagatc

SEQ ID NO: 112 - DNA, 1659 bp, Artificial Sequence
  sequence of STAR A28
gatcgaactttggtaacatgcttgcttactgctttctattgtctgcaaaacctctgttctgggtgaccttctggcccctctctctcgaagcttcagaactatggaggagagattggataaaggagacaaaaggtgtggtgtggcgaaatgttagggtaccggcaattgtgtatgtatgagttgattttgttcttttctcataaagaggatttaacaaaggatgagaaaacaaatccaacttgagtactacgaggagataaaagcttttattgggtattgagtattgacacgttgttgaaagtctgatacattttagacttttactgcatatgtccaaatatttagatttttttttcgtttctcaaaaaagtaacttgtttaacaaaaaaaaatcgttattgggcttttcgtttcttttatattgggccttgagcctttttagcttttgtatttttagtccttttcgggtttatttatttattaataagataccaaaaacataacaaaaatgtagttttgtatttttaacctagtcttttaaatatttaaacttaattagaaaaattctatttaaaatattataaaaaaaacatgattttgtgattttcccatattttgtgtaactatttttgacaagcttttgaaacaacaaagacaaaatccatgtgataaggtcggtcaaaaatcttgcgtagtagaggagttaaagatttttggatggttacaatggtatactcttatttgatatcccatcaatggtatatagctttgaatggtaggacaagtgagagtaaaattttctcatcattgctaagttttattttaggttctacattgtttcacccttcttaagtatcctactctcaactagaaaaaaaaattgtgagggcggttttatcggctggaatgcagctcatgtagctcccacgacggagttttctggctaagaaactcggacacaacgttggcctccaatatcttcaaggcttcttcattcgtcaccgacctcggtgtcttatactgactcacagaagagcctctagacagaaagaagttcatgagcttgtcgaaagcgccaggcttaacaaccttaatctcaagtggtccaatgttcttatcattctttcgtccttttctgtaaaccgcgtccagagactcctcaatggtgaagcagcattcctccaaaacattctggtcaagctcaagcttggcgtccttgacttttctcccgagttcccagtagagcacgtagtgacctggatacgaggaggaatccacacggctagtgaaatccatgagcattaggtcatgtggctcaagcaggagactcgcgttagtcactgccttgaggaggtcttcgtcgtaggtcttgtccatgtcgatgctcagaacaactttctgtcttcccacgaaatgaaactgtggcgcattgttgtagaaaccagtcactcttaaaacgtcccctaaacggtacctatacaaacctgtataaagaattttgatacacattaagaaaattattaacatgtcatttagttttgaaattgagagagtaaacaagaaaaaacacttaccagcaaacgttgtgacaacaggttcataatcatgaccgattttaacatcgacaagatcgactacaacaggattctctgcgggatc

SEQ ID NO: 113 - DNA, 874 bp, Artificial Sequence
  sequence of STAR A29
gatcagagtcacaaccataggagtcggagacggccatgcatgtgtcttgatagaagaattaaccggttctaaatctgaaaacgaatccggtcgtctcgaaccgaaatcaataaccggtccggtcaaagaaacggttgcacgagtgaaggaaacggttacgaaaacggagccgttaatatgcgatgacggagtgacaaaggggaagctgacgatgtgctacgaggtagacgttgacgttgacggtgggaggtgtgttaacggagatttaacggcagttagctacggaggaggtttgggtaattgtggcggggattggtgggagaaatgggatggagtggtgaggatgagaaatggtgatgacagttggtaccgttacgtggatttaacggtgattaatggaaatgtggtaaggttatgggatgacaacaaaacactagtaacggcggcatgtgtctaaattagagaagtttcatatttcggaaagtttttaaatcttgagaagctttcttggtttgaagtgttttttttttgttggttgattaagttgtaatttgtaaataattttcacacaagagaccaagaaggaacgcttaaatcaatatcaattggtgttgattcccagctttttctagtcgaacttaggtaacacgtccattgcgatgatgaattcgtgacaaggggtcaactatttgaacacaacaaacaagtgcgttttcttgttaaggcccatctaaaattgactacacacatttacttttaggcccattttaaacttgactgtagcctgtaggcatgtatttgttcgtgttactcccagcctcaaacccgcaaaatccacgaattcttcttacttagtctagactctggtctgatc

SEQ ID NO: 114 - DNA, 2138 bp, Artificial Sequence
  sequence of STAR A30
gatctggctaatccgtttagcacacaaccagatgtaacattggttgcaaagattattgaagagtctcgatctaatgtaacacacctctgcgcattcaggagtgcttacgtcaacacattccgggaacgaaaaactgttagcgtatgtgtattttaaagtattaccatatttctttatatcttctagcacctcctcacaaatgtcacgtgcgtcctccgattccaaagcataatggttgcttccgaagagccgaaggtagacaccacccatgtgagcattaccagcacatatgtaaagaattgcgcatgcaagggttgcagcggcgttccttggggcgattcgctctaagtgtaggatagctccctggatgtcagactcatgtgtaacgagacgcagtccttcatggtaaatagccgtggggttaccagcttgtaagcaccgtttgaagaagggtctatagcgaccttcggagttgatgtcatttggatcgtggcctgccgcgtagaagtcatcgggatcgtcgcacatgctgaaaatgtttgcatttttgaggacatccggacagtagacaatgtctcttccacgaggaccggatttcaacataggtccgaggtaccaccaacatttgtcagccattttcttggctatcttcgcaagcaaatcgtcaggaatatttgggtttgtcatatttaggagtaaggtgtttcgagaaaatgaaatttgaacacttaaataagcatcattgaagatatggttgggtaagttatggttgtatttattgcaaaggtattaagtgatgatgtgtattcatattgtcaaatcaaagtaatagtattccatatataatttgttatcgttgttatgagcaacctctttttattaacagcttaaaactagacgtgtacgttttactgacggtcttagtgtacgtccacatttacatttctacatttactcaacaaacagtgtacgttgtagtgtatgttttagtgaacgtccacatttacatttctacatttgcccaacaaacagtgtacgttgtagtgtacgtccacatttacatttctacatttgcccaacaaacagtgtacgttgtagtgtacgtttaagtgtacgtccacatttacatttctacatttgcccaacaaacagtgtacgttgtagtgtacgttttagtgtacgtccatatttacatttctacatttactcaacagacagtgtacgctgtagtgtactattagtgtacgtccattcataaatatcaccatttatgagacaaaccaaagacctcatacgtttgcatgtgttattttttagtgtacgttagagttgatatctcatgctagtgaacgtccatatctagttttccgagacaaagaaaaaacctctaagtattatttggtagatgcacgtgtacggagttgtggacgcttagattttaatatccaaatttacatttactgcagtgtctaaatatcatatgtgaatttggctgaaaaatattcaacttgagaaacataacacaccttgcaaatttcttaagcaataatataatttcaacataaacataaacaacatagtagaaggcttatcataatttgaaacatgacatagcggataacataaacaaacatataaagtagaatggaataactatagcatttgactaacacgcctggcacacgaccagaggtaacagcggttgcaaacgttttggaaagctcctgataccatgtaacaatataaggcgcaaggaggcatactaattccatggctggtaggataagagaacgtaggaccatatgtattgctgtatggagggtcaaacttctttatttcctcgatgaactcatcacccaaaactcgagtggcaaccgagtccaatggataatggttgcgggtgaagagctgtagaaacaagccgcccatataatcatacccagcacatatgaatacaatggcgcatgcaagtgttgcatttgctcgtactggagcatgacgctgtaagagcctgatggctccattgatgtttcgttcatgcgttagaacacgaataccttcgtaatacacggccgtgggattattagctgcaaaacaccttaagaaaaatgttcgatgtcggccttcatcagcggatc

SEQ ID NO: 115 - DNA, 2092 bp, Artificial Sequence
  sequence of STAR A31
gatcaaaagaatcgtacttgaaatatttagtggaacgcatatgtcagagttacagatatggtttaactctttttatctcctttttttaatggtgtttctctttttatctcctataatcttttgggaattttttattattaaatattaattaaaaagataaattcttagagaaaatcccaactgacttgttaactagtgagacatatcttatttattctctgcttatctaaaaagaaaatgaaaaagaaaaaaaaagtatatattagaagattaatataagtttagggggaaaatgattattattactatttataaaattagtatatttcaaaattgtacaattaattactaagccttaaaataaaaatgtaaaagaagattatcatcaagaatagtataccatctttgtttcaaaagaaaagtttactaaaagaaaaaacttttgtttaatttctactaaagctgaaaggaaaatgattgtcaatttgttattattattatttatatgatagatttcttaagaaacgtatagagttagttacaaattctaaattaaaaattgtatgataagattatcttaagaaagttatacaatatattcctaattctaaaagaaaatggttatttttttggaatagatatacacaacaaaacaaatttagtataagaagatatgttagattaactaaataaacatctcaggcatgaaactggattaggttaaccagaggtccagagacctatatatctctaggcattagggtttaactacggagcaaagcctcataatcaagtttatatcttgcgcatctttagcaaccaatcaattatctaagaagccatgactaatactaatgttgctgctacaaagcctctttctactatggtcgatgaatctcctagccttctccgtgattggtggtgagactctagatcaatgatttttcttacttttttcccattactatgttatgttacgtaacataagatggattaaactgaatctgatcctcttaaattatattggttgcagtatgaacaagaacctacaatacaactttgcgatgaacttcgtcatgataatcatcaacattgaagcaatcttgtctatcagaaaccacgaaaatcacgtaaggaaagattattcaacgattttgataatttccggtatgttcttgcctttcgcctattaagttgcgtttgttgggttggcgcaatcagggatgtgacattatgtgaactcgcctacatcttcggacgcatcagtcacaacataggctttattttcttcctagaactcctctattgtatttctccctacttggctctactcgttggtctacatgtaggccaatggtatctaacttccatgattggactgtctctatgggaaggaatgcaagcattacgaactgatatttaacctcgtttaatagtaaaatctaaacttatttagctgcatattttggtttaaggcaatcgagaatgtcttagcatctaaagcttacttcgtgggacgcatctgtcacacgttcggcttttgtattttcgtccacctcctctattcggtttctcctcacttggctctatacttcggtctcccttgtttgctaggtttcgtagccgtcatgattgcaccaagttgtccgtatcaatggaaaggcctatgcaacaaagtgcaagagttacgagactggtggaagcatgtgaatcgaccacaatcctcggttgttattgttcaaggatctccatttctaagatgtgaattttaggactcttttatcccttttgccttttaaattggaataccaacgtttattatgtgggttagttatgtgtgtatatgatatacaaatcaaacaacatatataaggagaagagatattgaatgttgattcttaatttacaggaacatgaagctcgggtctttccggcaatgccatcaatatccgaggcggtgcagtttcttcgtcagacgagaaaccagagagtctagtatcctaattttgaacaaatagagcataaaggaacaagttatatagcttcacataacccgaaacatgttttaagtttcaatatcaaagacaagatc

SEQ ID NO: 116 - DNA, 1290 bp, Artificial Sequence
  sequence of STAR A32
gatctagacatatgtgtgagacgtttcattgtaggtatctgaatgtaaagctcaaagctttaacctttgaaccgataaacctctaaagctctctcttttccttggatgagtctcacaagttaagaacttcagtgaaataatctgactttattgaacccaaacttgggtatcactgtttatcttagcattacagagttttgtttttgttatgtacattggatttgaagtctacaatgtttttccaggtttataaaccggaagaatatagccgggttctagctatctgtggtcctgggaacaatggtggtgatggtttggtggcggcgaggcatttgcaccactttggatataaaccgtttatttgttatcccaaacgtacagccaagccactttatactggactggtcactcaggtttgtgtaaccagtgcttaatttatgggggatctttgttagctttctccgtttctttactgcctgctgaatttgcctgtttttgtagttggattcactctcagtcccttttgtttccgttgaggatctgccggatgacttgtcaaaggactttgatgttattgtagatgcaatgtttgggttttcattccatggtaactatttttgtgcatgaatcgttagaattcttcaaagcatgaaacaattataagaagtaaattcatcaaacttttgaacagcaagttttggaatcaaagtctcagagatgcaccttattcatttgcatcatgtttcagttggcctttgaaaatccattttttgcacatgtaggagctcccaggcctccttttgatgacctcatccggcgattagtatcgttacagaactatgagcagactcttcaaaaacacccagtcattgtctctgtggatattccctctggttggcacgttgaagaaggagaccatgaagatggaggaattaagcctgatatgttggtaagtcttagccgaaatgcttgtgtttctctttttctcttgtactcatttgttactatctgatataatgaaaactactttataaattgaacatatttactctttttaggtatctttgactgccccaaaattatgtgcaaagagattccgtggccctcatcactttttaggtgggagatttgtaccaccttctgttgcagaaaagtataagctggagctccctagttacccagggacatctatgtgtgttagaattggtaaacctcccaaagttgacatatctgctatgagagtgaactatgtctctccagaattgcttgaggagcaggttgaaactgatc

SEQ ID NO: 117 - DNA, 869 bp, Artificial Sequence
  sequence of STAR A33
gatcccgttcatgtatttttgccagttcgagttggggttggttctgtttactttttctagtccatgtattttgcagacctattaaaaccattctgttttttttttggaccaacaaaacccatccgtttttagatacgaaaataaaattttattaaaaccattatttttcttggaccatcaaaacccatccgtttaaagatacgaaatgaaattcgattgataaatacaaaataaagttcaccaaacttaaataaaaaggcatagatgggaccaatgagaaagaaatttcttttctcctcaatttccccaaaaatatataaaccttaagtttacttttttgttgcaaggaaaaacattaatctttttcaactttctaaaaacaatcatttcaaacgttaaaggaacctcctcctttctttacgcgtttgcaatataacccaagaagaccgcttgtttgtacaactttccaaaaaccaaacagtagtgtaataaacctctgacttcttttttcttctctatttttgtgggtgataatcaattcactcggtttgaaatttcgtccacttttcaaagatgagtgaatgaaaaagccacgaaactttccatttcttcctctgtgtataactctcactgagtacgacttgccattttctcatccaaaaaaaatgtttatccaaatacatatttgtgaactttgcttttaaaccactcaagattcttccccatggcttcttcgtcttcttcttctcggtctcgcacctggagataccgcgtcttcacgaacttccatggacctgacgtccgtaaaacattcctcagccatttacgtaaacagtttagctacaacgggatttcgatgtttaatgatc

SEQ ID NO: 118 - DNA, 921 bp, Artificial Sequence
  sequence of STAR A34
gatccatgcttttgagtttaagtgatttatttaagatcctctaaacttttttttcttcacttagtggtggttccagtcaatttagcaagtaagatgttgtatgtgtcaatgctataactgtgaattttcagctattgtagtttgatttttgtctttgttagcttcaggtgtcttgaatctgaatctgtggctatatttggtgctcggtggtgagcaggaagggagggggatattgtcagggttttaatgtacgtcagatgaatagagcaactaatgttactggcagtagaaggagggggtttattctcagcgtccgcgtctgggtatagtaagggattgacccttcttttctctggtgataaagacgtagataggcccatgagagttgtcccgtggaatcactaccaggtggttgaccaagagcctgaggctgaccctgttcttcagctggattctattaagaaccgagtttcccgcggttgcgctgcttccttcagttgttttggtggcgcttccgcgggacttgagaccccttctcctcttaaagttgaacctgtgcagcagcagcatcgtgaaatatcatcaccagagtctgttgttgttgtttctgaaaagggtaaagaccaaataagtgaagctgataatggcagcagcaaagaagctttcaaactctcgttgaggagtagcttgaagaggccctctgttgcggaatcacgctctctagaagatataaaagaatacgagacgttgagtgtggatggtagcgatctcactggtgacatggcaaggcggaaagttcagtggcctgatgcttgtggtagtgaactcactcaagttagagaatttgagccgaggtacgtgtgatatgttttcctcttattgagttgcttaaatcccaatacgagttaatttaagtagatc

SEQ ID NO: 119 - DNA, 1140 bp, Artificial Sequence; identical to SEQ ID NO: 97
  sequence of STAR A35

SEQ ID NO: 120 - DNA, 6 bp, Artificial Sequence
  palindromic DNA sequence
  misc_feature (3)..(4): "N" stands for any nucleotide
canntg

SEQ ID NO: 121 - DNA, 6 bp, Artificial Sequence
  oligonucleotide
aaaaaa

SEQ ID NO: 122 - DNA, 6 bp, Artificial Sequence
  oligonucleotide
tttttt

SEQ ID NO: 123 - DNA, 6 bp, Artificial Sequence
  hexamer
acgtga

SEQ ID NO: 124 - DNA, 26 bp, Artificial Sequence
  oligonucleotide
gtacggatatcagatctttaattaag

SEQ ID NO: 125 - DNA, 26 bp, Artificial Sequence
  oligonucleotide
gtaccttaattaaagatctgatatcc

SEQ ID NO: 126 - DNA, 51 bp, Artificial Sequence
  primer
atcagatctggcgcgccatttaaatcgtctcgcgcgtttcggtgatgacgg

SEQ ID NO: 127 - DNA, 41 bp, Artificial Sequence
  primer
aggcggatccgaatgtatttagaaaaataaacaaatagggg

SEQ ID NO: 128 - DNA, 36 bp, Artificial Sequence
  primer
gatcggatccttcgaaatggccaagttgaccagtgc

SEQ ID NO: 129 - DNA, 32 bp, Artificial Sequence
  primer
aggcgcggccgcaattctcagtcctgctcctc

SEQ ID NO: 130 - DNA, 31 bp, Artificial Sequence
  primer
gatcgaattctcgcgacttcgcccaccatgc

SEQ ID NO: 131 - DNA, 47 bp, Artificial Sequence
  primer
aggcgaattcaccggtgtttaaactcatgtctgctcgaagcggccgg

SEQ ID NO: 132 - DNA, 31 bp, Artificial Sequence
  primer
gatcgaattcatggtgagcaagggcgaggag

SEQ ID NO: 133 - DNA, 40 bp, Artificial Sequence
  primer
aggcacgcgtgttaacctacacattgatcctagcagaagc

SEQ ID NO: 134 - DNA, 48 bp, Artificial Sequence
  oligonucleotide C65
aacaagcttgatatcagatctgctagcttggtcgagctgatacttccc

SEQ ID NO: 135 - DNA, 54 bp, Artificial Sequence
  oligonucleotide C66
aaactcgagcggccgcgaattcgtcgactttaccactccctatcagtgatagag

SEQ ID NO: 136 - DNA, 39 bp, Artificial Sequence
  oligonucleotide C67
aaaccgcggcatggaagacgccaaaaacataaagaaagg

SEQ ID NO: 137 - DNA, 32 bp, Artificial Sequence
  oligonucleotide C68
tatggatcctagaattacacggcgatctttcc

SEQ ID NO: 138 - DNA, 33 bp, Artificial Sequence
  oligonucleotide C81
aaaccatggccgagtacaagcccacggtgcgcc

SEQ ID NO: 139 - DNA, 35 bp, Artificial Sequence
  oligonucleotide C82
aaatctagatcaggcaccgggcttgcgggtcatgc

SEQ ID NO: 140 - DNA, 22 bp, Artificial Sequence
  oligonucleotide C85
catttccccgaaaagtgccacc

SEQ ID NO: 141 - DNA, 24 bp, Artificial Sequence
  oligonucleotide D30
tcactgctagcgagtggtaaactc

SEQ ID NO: 142 - DNA, 28 bp, Artificial Sequence
  oligonucleotide D41
gaagtcgacgaggcaggcagaagtatgc

SEQ ID NO: 143 - DNA, 29 bp, Artificial Sequence
  oligonucleotide D42
gagccgcggtttagttcctcaccttgtcg

SEQ ID NO: 144 - DNA, 23 bp, Artificial Sequence
  oligonucleotide D51
tctggaagctttgctgaagaaac

SEQ ID NO: 145 - DNA, 17 bp, Artificial Sequence
  oligonucleotide D58
ccaagttgaccagtgcc

SEQ ID NO: 146 - DNA, 19 bp, Artificial Sequence
  oligonucleotide D70
tacaagccaaccacggcct

SEQ ID NO: 147 - DNA, 20 bp, Artificial Sequence
  oligonucleotide D71
cggaagtgcttgacattggg

SEQ ID NO: 148 - DNA, 20 bp, Artificial Sequence
  oligonucleotide D80
gttcgtggacacgacctccg

SEQ ID NO: 149 - DNA, 21 bp, Artificial Sequence
  oligonucleotide D89
gggcaagatgtcgtagtcagg

SEQ ID NO: 150 - DNA, 30 bp, Artificial Sequence
  oligonucleotide D90
aggcccatggtcacctccatcgctactgtg

SEQ ID NO: 151 - DNA, 20 bp, Artificial Sequence
  oligonucleotide D91
ctaatcactcactgtgtaat

SEQ ID NO: 152 - DNA, 15 bp, Artificial Sequence
  oligonucleotide D93
aattacaggcgcgcc

SEQ ID NO: 153 - DNA, 15 bp, Artificial Sequence
  oligonucleotide D94
aattggcgcgcctgt

SEQ ID NO: 154 - DNA, 25 bp, Artificial Sequence
  oligonucleotide D95
tgctttgcatacttctgcctgcctc

SEQ ID NO: 155 - DNA, 20 bp, Artificial Sequence
  oligonucleotide E12
taggggggatccaaatgttc

SEQ ID NO: 156 - DNA, 20 bp, Artificial Sequence
  oligonucleotide E13
cctaaaagaagatctttagc

SEQ ID NO: 157 - DNA, 20 bp, Artificial Sequence
  oligonucleotide E14
aagtgttggatccactttgg

SEQ ID NO: 158 - DNA, 20 bp, Artificial Sequence
  oligonucleotide E15
tttgaagatctaccaaatgg

SEQ ID NO: 159 - DNA, 20 bp, Artificial Sequence
  oligonucleotide E16
gttcgggatccacctggccg

SEQ ID NO: 160 - DNA, 20 bp, Artificial Sequence
  oligonucleotide E17
taggcaagatcttggccctc

SEQ ID NO: 161 - DNA, 20 bp, Artificial Sequence
  oligonucleotide E18
cctctctagggatccgaccc

SEQ ID NO: 162 - DNA, 20 bp, Artificial Sequence
  oligonucleotide E19
ctagagagatcttccagtat

SEQ ID NO: 163 - DNA, 20 bp, Artificial Sequence
  oligonucleotide E20
agagttccggatccgcctgg

SEQ ID NO: 164 - DNA, 20 bp, Artificial Sequence
  oligonucleotide E21
ccaggcagactcggaactct

SEQ ID NO: 165 - DNA, 20 bp, Artificial Sequence
  oligonucleotide E22
tggtgaaaccggatccctac

SEQ ID NO: 166 - DNA, 20 bp, Artificial Sequence
  oligonucleotide E23
aggtcaggagatctagacca

SEQ ID NO: 167 - DNA, 22 bp, Artificial Sequence
  oligonucleotide E25
ccattttcgcttccttagctcc

SEQ ID NO: 168 - DNA, 22 bp, Artificial Sequence
  oligonucleotide E42
cgatgtaacccactcgtgcacc

SEQ ID NO: 169 - DNA, 20 bp, Artificial Sequence
  oligonucleotide E57
agagatctaggataatttcg

SEQ ID NO: 170 - DNA, 36 bp, Artificial Sequence
  oligonucleotide E92
aggcgctagcacgcgttctactcttttcctactctg

SEQ ID NO: 171 - DNA, 35 bp, Artificial Sequence
  oligonucleotide E93
gatcaagcttacgcgtctaaaggcattttatatag

SEQ ID NO: 172 - DNA, 35 bp, Artificial Sequence
  oligonucleotide E94
aggcgctagcacgcgttcagagttagtgatccagg

SEQ ID NO: 173 - DNA, 35 bp, Artificial Sequence
  oligonucleotide E95
gatcaagcttacgcgtcagtaaaggtttcgtatgg

SEQ ID NO: 174 - DNA, 36 bp, Artificial Sequence
  oligonucleotide E96
aggcgctagcacgcgttctactctttcattactctg

SEQ ID NO: 175 - DNA, 26 bp, Artificial Sequence
  oligonucleotide E97
cgaggaagctggagaaggagaagctg

SEQ ID NO: 176 - DNA, 25 bp, Artificial Sequence
  oligonucleotide E98
caagggccgcagcttacacatgttc

SEQ ID NO: 177 - DNA, 6 bp, Artificial Sequence
  oligonucleotide patterns over-represented in STAR elements
ccccac

SEQ ID NO: 178 - DNA, 6 bp, Artificial Sequence
  oligonucleotide patterns over-represented in STAR elements
cagcgg

SEQ ID NO: 179 - DNA, 6 bp, Artificial Sequence
  oligonucleotide patterns over-represented in STAR elements
ggcccc

SEQ ID NO: 180 - DNA, 6 bp, Artificial Sequence
  oligonucleotide patterns over-represented in STAR elements
cagccc

SEQ ID NO: 181 - DNA, 6 bp, Artificial Sequence
  oligonucleotide patterns over-represented in STAR elements
gccccc

SEQ ID NO: 182 - DNA, 6 bp, Artificial Sequence
  oligonucleotide patterns over-represented in STAR elements
cggggc

SEQ ID NO: 183 - DNA, 6 bp, Artificial Sequence
  oligonucleotide patterns over-represented in STAR elements
ccccgc

SEQ ID NO: 184 - DNA, 6 bp, Artificial Sequence
  oligonucleotide patterns over-represented in STAR elements
cggcag

SEQ ID NO: 185 - DNA, 6 bp, Artificial Sequence
  oligonucleotide patterns over-represented in STAR elements
agcccc

SEQ ID NO: 186 - DNA, 6 bp, Artificial Sequence
  oligonucleotide patterns over-represented in STAR elements
ccaggg

SEQ ID NO: 187 - DNA, 6 bp, Artificial Sequence
  oligonucleotide patterns over-represented in STAR elements
ggaccc

SEQ ID NO: 188 - DNA, 6 bp, Artificial Sequence
  oligonucleotide patterns over-represented in STAR elements
gcggac

SEQ ID NO: 189 - DNA, 6 bp, Artificial Sequence
  oligonucleotide patterns over-represented in STAR elements
ccagcg

SEQ ID NO: 190 - DNA, 6 bp, Artificial Sequence
  oligonucleotide patterns over-represented in STAR elements
gcagcc

SEQ ID NO: 191 - DNA, 6 bp, Artificial Sequence
  oligonucleotide patterns over-represented in STAR elements
ccggca

SEQ ID NO: 192 - DNA, 6 bp, Artificial Sequence
  oligonucleotide patterns over-represented in STAR elements
agcggc

SEQ ID NO: 193 - DNA, 6 bp, Artificial Sequence
  oligonucleotide patterns over-represented in STAR elements
cagggg

SEQ ID NO: 194 - DNA, 6 bp, Artificial Sequence
  oligonucleotide patterns over-represented in STAR elements
ccgccc

SEQ ID NO: 195 - DNA, 6 bp, Artificial Sequence
  oligonucleotide patterns over-represented in STAR elements
cccccg

SEQ ID NO: 196 - DNA, 6 bp, Artificial Sequence
  oligonucleotide patterns over-represented in STAR elements
gccgcc

SEQ ID NO: 197 - DNA, 6 bp, Artificial Sequence
  oligonucleotide patterns over-represented in STAR elements
gccggc

SEQ ID NO: 198 - DNA, 6 bp, Artificial Sequence
  oligonucleotide patterns over-represented in STAR elements
cggacc

SEQ ID NO: 199 - DNA, 6 bp, Artificial Sequence
  oligonucleotide patterns over-represented in STAR elements
cgcccc

SEQ ID NO: 200 - DNA, 6 bp, Artificial Sequence
  oligonucleotide patterns over-represented in STAR elements
cgccag

SEQ ID NO: 201 - DNA, 6 bp, Artificial Sequence
  oligonucleotide patterns over-represented in STAR elements
cgcagc

SEQ ID NO: 202 - DNA, 6 bp, Artificial Sequence
  oligonucleotide patterns over-represented in STAR elements
cagccg

SEQ ID NO: 203 - DNA, 6 bp, Artificial Sequence
  oligonucleotide patterns over-represented in STAR elements
cccacg

SEQ ID NO: 204 - DNA, 6 bp, Artificial Sequence
  oligonucleotide patterns over-represented in STAR elements
gctgcc

SEQ ID NO: 205 - DNA, 6 bp, Artificial Sequence
  oligonucleotide patterns over-represented in STAR elements
ccctcc

SEQ ID NO: 206 - DNA, 6 bp, Artificial Sequence
  oligonucleotide patterns over-represented in STAR elements
ccctgc

SEQ ID NO: 207 - DNA, 6 bp, Artificial Sequence
  oligonucleotide patterns over-represented in STAR elements
cacccc

SEQ ID NO: 208 - DNA, 6 bp, Artificial Sequence
  oligonucleotide patterns over-represented in STAR elements
gcgcca

SEQ ID NO: 209 - DNA, 6 bp, Artificial Sequence
  oligonucleotide patterns over-represented in STAR elements
aggggc

SEQ ID NO: 210 - DNA, 6 bp, Artificial Sequence
  oligonucleotide patterns over-represented in STAR elements
gagggc

SEQ ID NO: 211 - DNA, 6 bp, Artificial Sequence
  oligonucleotide patterns over-represented in STAR elements
gcgaac

SEQ ID NO: 212 - DNA, 6 bp, Artificial Sequence
  oligonucleotide patterns over-represented in STAR elements
ccggcg

SEQ ID NO: 213 - DNA, 6 bp, Artificial Sequence
  oligonucleotide patterns over-represented in STAR elements
agccgg

SEQ ID NO: 214 - DNA, 6 bp, Artificial Sequence
  oligonucleotide patterns over-represented in STAR elements
ggagcc

SEQ ID NO: 215 - DNA, 6 bp, Artificial Sequence
  oligonucleotide patterns over-represented in STAR elements
ccccag

SEQ ID NO: 216 - DNA, 6 bp, Artificial Sequence
  oligonucleotide patterns over-represented in STAR elements
ccgctc

SEQ ID NO: 217 - DNA, 6 bp, Artificial Sequence
  oligonucleotide patterns over-represented in STAR elements
cccctc

SEQ ID NO: 218 - DNA, 6 bp, Artificial Sequence
  oligonucleotide patterns over-represented in STAR elements
caccgc

SEQ ID NO: 219 - DNA, 6 bp, Artificial Sequence
  oligonucleotide patterns over-represented in STAR elements
ctgccc

SEQ ID NO: 220 - DNA, 6 bp, Artificial Sequence
  oligonucleotide patterns over-represented in STAR elements
gggcca

SEQ ID NO: 221 - DNA, 6 bp, Artificial Sequence
  oligonucleotide patterns over-represented in STAR elements
cgctgc

SEQ ID NO: 222 - DNA, 6 bp, Artificial Sequence
  oligonucleotide patterns over-represented in STAR elements
cagcgc

SEQ ID NO: 223 - DNA, 6 bp, Artificial Sequence
  oligonucleotide patterns over-represented in STAR elements
cggccc

SEQ ID NO: 224 - DNA, 6 bp, Artificial Sequence
  oligonucleotide patterns over-represented in STAR elements
ccgccg

SEQ ID NO: 225 - DNA, 6 bp, Artificial Sequence
  oligonucleotide patterns over-represented in STAR elements
ccccgg

SEQ ID NO: 226 - DNA, 6 bp, Artificial Sequence
  oligonucleotide patterns over-represented in STAR elements
agccgc

SEQ ID NO: 227 - DNA, 6 bp, Artificial Sequence
  oligonucleotide patterns over-represented in STAR elements
gcaccc

SEQ ID NO: 228 - DNA, 6 bp, Artificial Sequence
  oligonucleotide patterns over-represented in STAR elements
aggacc

SEQ ID NO: 229 - DNA, 6 bp, Artificial Sequence
  oligonucleotide patterns over-represented in STAR elements
agggcg

SEQ ID NO: 230 - DNA, 6 bp, Artificial Sequence
  oligonucleotide patterns over-represented in STAR elements
cagggc

SEQ ID NO: 231 - DNA, 6 bp, Artificial Sequence
  oligonucleotide patterns over-represented in STAR elements
cccgcc

SEQ ID NO: 232 - DNA, 6 bp, Artificial Sequence
  oligonucleotide patterns over-represented in STAR elements
gccagc

SEQ ID NO: 233 - DNA, 6 bp, Artificial Sequence
  oligonucleotide patterns over-represented in STAR elements
agcgcc

SEQ ID NO: 234 - DNA, 6 bp, Artificial Sequence
  oligonucleotide patterns over-represented in STAR elements
aggccc

SEQ ID NO: 235 - DNA, 6 bp, Artificial Sequence
  oligonucleotide patterns over-represented in STAR elements
cccacc

SEQ ID NO: 236 - DNA, 6 bp, Artificial Sequence
  oligonucleotide patterns over-represented in STAR elements
cgctca

SEQ ID NO: 237 - DNA, 6 bp, Artificial Sequence
  oligonucleotide patterns over-represented in STAR elements
aacgcg

SEQ ID NO: 238 - DNA, 6 bp, Artificial Sequence
  oligonucleotide patterns over-represented in STAR elements
gcggca

SEQ ID NO: 239 - DNA, 6 bp, Artificial Sequence
  oligonucleotide patterns over-represented in STAR elements
aggtcc

SEQ ID NO: 240 - DNA, 6 bp, Artificial Sequence
  oligonucleotide patterns over-represented in STAR elements
ccgtca

SEQ ID NO: 241 - DNA, 6 bp, Artificial Sequence
  oligonucleotide patterns over-represented in STAR elements
cagagg

SEQ ID NO: 242 - DNA, 6 bp, Artificial Sequence
  oligonucleotide patterns over-represented in STAR elements
cccgag

SEQ ID NO: 243 - DNA, 6 bp, Artificial Sequence
  oligonucleotide patterns over-represented in STAR elements
ccgagg

SEQ ID NO: 244 - DNA, 6 bp, Artificial Sequence
  oligonucleotide patterns over-represented in STAR elements
cgcgga

SEQ ID NO: 245 - DNA, 6 bp, Artificial Sequence
  oligonucleotide patterns over-represented in STAR elements
ccaccc

SEQ ID NO: 246 - DNA, 6 bp, Artificial Sequence
  oligonucleotide patterns over-represented in STAR elements
cctcgc

SEQ ID NO: 247 - DNA, 6 bp, Artificial Sequence
  oligonucleotide patterns over-represented in STAR elements
caagcc

SEQ ID NO: 248 - DNA, 6 bp, Artificial Sequence
  oligonucleotide patterns over-represented in STAR elements
tccgca

SEQ ID NO: 249 - DNA, 6 bp, Artificial Sequence
  oligonucleotide patterns over-represented in STAR elements
cgccgc

SEQ ID NO: 250 - DNA, 6 bp, Artificial Sequence
  oligonucleotide patterns over-represented in STAR elements
gggaac

SEQ ID NO: 251 - DNA, 6 bp, Artificial Sequence
  oligonucleotide patterns over-represented in STAR elements
ccagag

SEQ ID NO: 252 - DNA, 6 bp, Artificial Sequence
  oligonucleotide patterns over-represented in STAR elements
cgttcc

SEQ ID NO: 253 - DNA, 6 bp, Artificial Sequence
  oligonucleotide patterns over-represented in STAR elements
cgagga

SEQ ID NO: 254 - DNA, 6 bp, Artificial Sequence
  oligonucleotide patterns over-represented in STAR elements
gggacc

SEQ ID NO: 255 - DNA, 6 bp, Artificial Sequence
  oligonucleotide patterns over-represented in STAR elements
ccgcga

SEQ ID NO: 256 - DNA, 6 bp, Artificial Sequence
  oligonucleotide patterns over-represented in STAR elements
cctgcg

SEQ ID NO: 257 - DNA, 6 bp, Artificial Sequence
  oligonucleotide patterns over-represented in STAR elements
ctgcgc

SEQ ID NO: 258 - DNA, 6 bp, Artificial Sequence
  oligonucleotide patterns over-represented in STAR elements
gacccc

SEQ ID NO: 259 - DNA, 6 bp, Artificial Sequence
  oligonucleotide patterns over-represented in STAR elements
gctcca

SEQ ID NO: 260 - DNA, 6 bp, Artificial Sequence
  oligonucleotide patterns over-represented in STAR elements
cgccac

SEQ ID NO: 261 - DNA, 6 bp, Artificial Sequence
  oligonucleotide patterns over-represented in STAR elements
gcggga

SEQ ID NO: 262 - DNA, 6 bp, Artificial Sequence
  oligonucleotide patterns over-represented in STAR elements
ctgcga

SEQ ID NO: 263 - DNA, 6 bp, Artificial Sequence
  oligonucleotide patterns over-represented in STAR elements
ctgctc

SEQ ID NO: 264 - DNA, 6 bp, Artificial Sequence
  oligonucleotide patterns over-represented in STAR elements
cagacg

SEQ ID NO: 265 - DNA, 6 bp, Artificial Sequence
  oligonucleotide patterns over-represented in STAR elements
cgagag

SEQ ID NO: 266 - DNA, 6 bp, Artificial Sequence
  oligonucleotide patterns over-represented in STAR elements
cggtgc

SEQ ID NO: 267 - DNA, 6 bp, Artificial Sequence
  oligonucleotide patterns over-represented in STAR elements
ctcccc

SEQ ID NO: 268 - DNA, 6 bp, Artificial Sequence
  oligonucleotide patterns over-represented in STAR elements
gcggcc

SEQ ID NO: 269 - DNA, 6 bp, Artificial Sequence
  oligonucleotide patterns over-represented in STAR elements
cggcgc

SEQ ID NO: 270 - DNA, 6 bp, Artificial Sequence
  oligonucleotide patterns over-represented in STAR elements
aagccc

SEQ ID NO: 271 - DNA, 6 bp, Artificial Sequence
  oligonucleotide patterns over-represented in STAR elements
ccgcag

SEQ ID NO: 272 - DNA, 6 bp, Artificial Sequence
  oligonucleotide patterns over-represented in STAR elements
gcccac

SEQ ID NO: 273 - DNA, 6 bp, Artificial Sequence
  oligonucleotide patterns over-represented in STAR elements
caccca

SEQ ID NO: 274 - DNA, 6 bp, Artificial Sequence
  oligonucleotide patterns over-represented in STAR elements
gcgccc

SEQ ID NO: 275 - DNA, 6 bp, Artificial Sequence
  oligonucleotide patterns over-represented in STAR elements
accggc

SEQ ID NO: 276 - DNA, 6 bp, Artificial Sequence
  oligonucleotide patterns over-represented in STAR elements
ctcgca

SEQ ID NO: 277 - DNA, 6 bp, Artificial Sequence
  oligonucleotide patterns over-represented in STAR elements
acgctc

SEQ ID NO: 278 - DNA, 6 bp, Artificial Sequence
  oligonucleotide patterns over-represented in STAR elements
ctggac

SEQ ID NO: 279 - DNA, 6 bp, Artificial Sequence
  oligonucleotide patterns over-represented in STAR elements
gcccca

SEQ ID NO: 280 - DNA, 6 bp, Artificial Sequence
  oligonucleotide patterns over-represented in STAR elements
accgtc

SEQ ID NO: 281 - DNA, 6 bp, Artificial Sequence
  oligonucleotide patterns over-represented in STAR elements
ccctcg

SEQ ID NO: 282 - DNA, 6 bp, Artificial Sequence
  oligonucleotide patterns over-represented in STAR elements
agcccg

SEQ ID NO: 283 - DNA, 6 bp, Artificial Sequence
  oligonucleotide patterns over-represented in STAR elements
acccga

SEQ ID NO: 284 - DNA, 6 bp, Artificial Sequence
  oligonucleotide patterns over-represented in STAR elements
agcagc

SEQ ID NO: 285 - DNA, 6 bp, Artificial Sequence
  oligonucleotide patterns over-represented in STAR elements
accgcg

SEQ ID NO: 286 - DNA, 6 bp, Artificial Sequence
  oligonucleotide patterns over-represented in STAR elements
cgaggc

SEQ ID NO: 287 - DNA, 6 bp, Artificial Sequence
  oligonucleotide patterns over-represented in STAR elements
agctgc

SEQ ID NO: 288 - DNA, 6 bp, Artificial Sequence
  oligonucleotide patterns over-represented in STAR elements
ggggac

SEQ ID NO: 289 - DNA, 6 bp, Artificial Sequence
  oligonucleotide patterns over-represented in STAR elements
ccgcaa

SEQ ID NO: 290 - DNA, 6 bp, Artificial Sequence
  oligonucleotide patterns over-represented in STAR elements
cgtcgc

SEQ ID NO: 291 - DNA, 6 bp, Artificial Sequence
  oligonucleotide patterns over-represented in STAR elements
cgtgac

SEQ ID NO: 292 - DNA, 6 bp, Artificial Sequence
  oligonucleotide patterns over-represented in STAR elements
cgccca

SEQ ID NO: 293 - DNA, 6 bp, Artificial Sequence
  oligonucleotide patterns over-represented in STAR elements
ctctgc

SEQ ID NO: 294 - DNA, 6 bp, Artificial Sequence
  oligonucleotide patterns over-represented in STAR elements
agcggg

SEQ ID NO: 295 - DNA, 6 bp, Artificial Sequence
  oligonucleotide patterns over-represented in STAR elements
accgct

SEQ ID NO: 296 - DNA, 6 bp, Artificial Sequence
  oligonucleotide patterns over-represented in STAR elements
cccagg

SEQ ID NO: 297 - DNA, 6 bp, Artificial Sequence
  oligonucleotide patterns over-represented in STAR elements
ccctca

SEQ ID NO: 298 - DNA, 6 bp, Artificial Sequence
  oligonucleotide patterns over-represented in STAR elements
ccccca

SEQ ID NO: 299 - DNA, 6 bp, Artificial Sequence
  oligonucleotide patterns over-represented in STAR elements
ggcgaa

SEQ ID NO: 300 - DNA, 6 bp, Artificial Sequence
  oligonucleotide patterns over-represented in STAR elements
cggctc

SEQ ID NO: 301 - DNA, 6 bp, Artificial Sequence
  oligonucleotide patterns over-represented in STAR elements
ctcgcc

SEQ ID NO: 302 - DNA, 6 bp, Artificial Sequence
  oligonucleotide patterns over-represented in STAR elements
cggaga

SEQ ID NO: 303 - DNA, 6 bp, Artificial Sequence
  oligonucleotide patterns over-represented in STAR elements
tcccca

SEQ ID NO: 304 - DNA, 6 bp, Artificial Sequence
  oligonucleotide patterns over-represented in STAR elements
gacacc

SEQ ID NO: 305 - DNA, 6 bp, Artificial Sequence
  oligonucleotide patterns over-represented in STAR elements
ctccga

SEQ ID NO: 306 - DNA, 6 bp, Artificial Sequence
  oligonucleotide patterns over-represented in STAR elements
ctcgtc

SEQ ID NO: 307 - DNA, 6 bp, Artificial Sequence
  oligonucleotide patterns over-represented in STAR elements
cgacca

SEQ ID NO: 308 - DNA, 6 bp, Artificial Sequence
  oligonucleotide patterns over-represented in STAR elements
atgacg

SEQ ID NO: 309 - DNA, 6 bp, Artificial Sequence
  oligonucleotide patterns over-represented in STAR elements
ccatcg

SEQ ID NO: 310 - DNA, 6 bp, Artificial Sequence
  oligonucleotide patterns over-represented in STAR elements
agggga

SEQ ID NO: 311 - DNA, 6 bp, Artificial Sequence
  oligonucleotide patterns over-represented in STAR elements
gctgca

SEQ ID NO: 312 - DNA, 6 bp, Artificial Sequence
  oligonucleotide patterns over-represented in STAR elements
acccca

SEQ ID NO: 313 - DNA, 6 bp, Artificial Sequence
  oligonucleotide patterns over-represented in STAR elements
cggagc

SEQ ID NO: 314 - DNA, 6 bp, Artificial Sequence
  oligonucleotide patterns over-represented in STAR elements
cctccg

SEQ ID NO: 315 - DNA, 6 bp, Artificial Sequence
  oligonucleotide patterns over-represented in STAR elements
cgggac

SEQ ID NO: 316 - DNA, 6 bp, Artificial Sequence
  oligonucleotide patterns over-represented in STAR elements
cctgga

SEQ ID NO: 317 - DNA, 6 bp, Artificial Sequence
  oligonucleotide patterns over-represented in STAR elements
aggcga

SEQ ID NO: 318 - DNA, 6 bp, Artificial Sequence
  oligonucleotide patterns over-represented in STAR elements
acccct

SEQ ID NO: 319 - DNA, 6 bp, Artificial Sequence
  oligonucleotide patterns over-represented in STAR elements
gctccc

SEQ ID NO: 320 - DNA, 6 bp, Artificial Sequence
  oligonucleotide patterns over-represented in STAR elements
cgtcac

SEQ ID NO: 321 - DNA, 6 bp, Artificial Sequence
  oligonucleotide patterns over-represented in STAR elements
agcgca

SEQ ID NO: 322 - DNA, 6 bp, Artificial Sequence
  oligonucleotide patterns over-represented in STAR elements
gaagcc

SEQ ID NO: 323 - DNA, 6 bp, Artificial Sequence
  oligonucleotide patterns over-represented in STAR elements
gaggcc

SEQ ID NO: 324 - DNA, 6 bp, Artificial Sequence
  oligonucleotide patterns over-represented in STAR elements
accctc

SEQ ID NO: 325 - DNA, 6 bp, Artificial Sequence
  oligonucleotide patterns over-represented in STAR elements
cccggc

SEQ ID NO: 326 - DNA, 6 bp, Artificial Sequence
  oligonucleotide patterns over-represented in STAR elements
cgagaa

SEQ ID NO: 327 - DNA, 6 bp, Artificial Sequence
  oligonucleotide patterns over-represented in STAR elements
ccaccg

SEQ ID NO: 328 - DNA, 6 bp, Artificial Sequence
  oligonucleotide patterns over-represented in STAR elements
acttcg

SEQ ID NO: 329 - DNA, 6 bp, Artificial Sequence
  oligonucleotide patterns over-represented in STAR elements
gatgac

SEQ ID NO: 330 - DNA, 6 bp, Artificial Sequence
  oligonucleotide patterns over-represented in STAR elements
acgagg

SEQ ID NO: 331 - DNA, 6 bp, Artificial Sequence
  oligonucleotide patterns over-represented in STAR elements
ccggag

SEQ ID NO: 332 - DNA, 6 bp, Artificial Sequence
  oligonucleotide patterns over-represented in STAR elements
acccac

SEQ ID NO: 333 - DNA, 6 bp, Artificial Sequence
  oligonucleotide patterns over-represented in STAR elements
ctgggc

SEQ ID NO: 334 - DNA, 6 bp, Artificial Sequence
  oligonucleotide patterns over-represented in STAR elements
ccacgg

SEQ ID NO: 335 - DNA, 6 bp, Artificial Sequence
  oligonucleotide patterns over-represented in STAR elements
cggtcc

SEQ ID NO: 336 - DNA, 6 bp, Artificial Sequence
  oligonucleotide patterns over-represented in STAR elements
agcacc

SEQ ID NO: 337 - DNA, 6 bp, Artificial Sequence
  oligonucleotide patterns over-represented in STAR elements
acaccc

SEQ ID NO: 338 - DNA, 6 bp, Artificial Sequence
  oligonucleotide patterns over-represented in STAR elements
agggcc

SEQ ID NO: 339 - DNA, 6 bp, Artificial Sequence
  oligonucleotide patterns over-represented in STAR elements
cgcgaa

SEQ ID NO: 340 - DNA, 6 bp, Artificial Sequence
  oligonucleotide patterns over-represented in STAR elements
gagccc

SEQ ID NO: 341 - DNA, 6 bp, Artificial Sequence
  oligonucleotide patterns over-represented in STAR elements
ctgagc

SEQ ID NO: 342 - DNA, 6 bp, Artificial Sequence
  oligonucleotide patterns over-represented in STAR elements
aatcgg

SEQ ID NO: 343 - DNA, 8 bp, Artificial Sequence
  Dyad patterns over-represented in STAR elements
  misc_feature (4)..(5): "N" stands for any nucleotide
cccnncgg

SEQ ID NO: 344 - DNA, 12 bp, Artificial Sequence
  Dyad patterns over-represented in STAR elements
  misc_feature (4)..(9): "N" stands for any nucleotide
ccgnnnnnnccc

SEQ ID NO: 345 - DNA, 6 bp, Artificial Sequence
  Dyad patterns over-represented in STAR elements
cagcgg

SEQ ID NO: 346 - DNA, 21 bp, Artificial Sequence
  Dyad patterns over-represented in STAR elements
  misc_feature (4)..(18): "N" stands for any nucleotide
cgcnnnnnnnnnnnnnnnccc

SEQ ID NO: 347 - DNA, 15 bp, Artificial Sequence
  Dyad patterns over-represented in STAR elements
  misc_feature (4)..(12): "N" stands for any nucleotide
cggnnnnnnnnngcc

SEQ ID NO: 348 - DNA, 15 bp, Artificial Sequence
  Dyad patterns over-represented in STAR elements
  misc_feature (4)..(12): "N" stands for any nucleotide
cccnnnnnnnnncgc

SEQ ID NO: 349 - DNA, 7 bp, Artificial Sequence
  Dyad patterns over-represented in STAR elements
  misc_feature (4)..(4): "N" stands for any nucleotide
cccngcg

SEQ ID NO: 350 - DNA, 6 bp, Artificial Sequence
  Dyad patterns over-represented in STAR elements
ccccac

SEQ ID NO: 351 - DNA, 22 bp, Artificial Sequence
  Dyad patterns over-represented in STAR elements
  misc_feature (4)..(19): "N" stands for any nucleotide
agcnnnnnnnnnnnnnnnnccg

SEQ ID NO: 352 - DNA, 10 bp, Artificial Sequence
  Dyad patterns over-represented in STAR elements
  misc_feature (4)..(7): "N" stands for any nucleotide
cccnnnncgc

SEQ ID NO: 353 - DNA, 19 bp, Artificial Sequence
  Dyad patterns over-represented in STAR elements
  misc_feature (4)..(16): "N" stands for any nucleotide
cgcnnnnnnnnnnnnngga

SEQ ID NO: 354 - DNA, 22 bp, Artificial Sequence
  Dyad patterns over-represented in STAR elements
  misc_feature (4)..(19): "N" stands for any nucleotide
gcgnnnnnnnnnnnnnnnnccc

SEQ ID NO: 355 - DNA, 11 bp, Artificial Sequence
  Dyad patterns over-represented in STAR elements
  misc_feature (4)..(8): "N" stands for any nucleotide
cgcnnnnngca

SEQ ID NO: 356 - DNA, 20 bp, Artificial Sequence
  Dyad patterns over-represented in STAR elements
  misc_feature (4)..(17): "N" stands for any nucleotide
cccnnnnnnnnnnnnnnccc

SEQ ID NO: 357 - DNA, 10 bp, Artificial Sequence
  Dyad patterns over-represented in STAR elements
  misc_feature (4)..(7): "N" stands for any nucleotide
ctgnnnncgc

SEQ ID NO: 358 - DNA, 18 bp, Artificial Sequence
  Dyad patterns over-represented in STAR elements
  misc_feature (4)..(15): "N" stands for any nucleotide
ccannnnnnnnnnnngcg

SEQ ID NO: 359 - DNA, 17 bp, Artificial Sequence
  Dyad patterns over-represented in STAR elements
  misc_feature (4)..(14): "N" stands for any nucleotide
cggnnnnnnnnnnncag

SEQ ID NO: 360 - DNA, 11 bp, Artificial Sequence
  Dyad patterns over-represented in STAR elements
  misc_feature (4)..(8): "N" stands for any nucleotide
cccnnnnngcc

SEQ ID NO: 361 - DNA, 6 bp, Artificial Sequence
  Dyad patterns over-represented in STAR elements
gccccc

SEQ ID NO: 362 - DNA, 10 bp, Artificial Sequence
  Dyad patterns over-represented in STAR elements
  misc_feature (4)..(7): "N" stands for any nucleotide
cgcnnnngac

SEQ ID NO: 363 - DNA, 6 bp, Artificial Sequence
  Dyad patterns over-represented in STAR elements
cggcag

SEQ ID NO: 364 - DNA, 9 bp, Artificial Sequence
  Dyad patterns over-represented in STAR elements
  misc_feature (4)..(6): "N" stands for any nucleotide
cccnnncgc

SEQ ID NO: 365 - DNA, 7 bp, Artificial Sequence
  Dyad patterns over-represented in STAR elements
  misc_feature (4)..(4): "N" stands for any nucleotide
cgcngac

SEQ ID NO: 366 - DNA, 8 bp, Artificial Sequence
  Dyad patterns over-represented in STAR elements
  misc_feature (4)..(5): "N" stands for any nucleotide
gcgnngcc

SEQ ID NO: 367 - DNA, 10 bp, Artificial Sequence
  Dyad patterns over-represented in STAR elements
  misc_feature (4)..(7): "N" stands for any nucleotide
cccnnnngcc

SEQ ID NO: 368 - DNA, 7 bp, Artificial Sequence
  Dyad patterns over-represented in STAR elements
  misc_feature (4)..(4): "N" stands for any nucleotide
cccnccc

SEQ ID NO: 369 - DNA, 19 bp, Artificial Sequence
  Dyad patterns over-represented in STAR elements
  misc_feature (4)..(16): "N" stands for any nucleotide
ccgnnnnnnnnnnnnncag

SEQ ID NO: 370 - DNA, 10 bp, Artificial Sequence
  Dyad patterns over-represented in STAR elements
  misc_feature (4)..(7): "N" stands for any nucleotide
gccnnnngga

SEQ ID NO: 371 - DNA, 9 bp, Artificial Sequence
  Dyad patterns over-represented in STAR elements
  misc_feature (4)..(6): "N" stands for any nucleotide
ccgnnngga

SEQ ID NO: 372 - DNA, 8 bp, Artificial Sequence
  Dyad patterns over-represented in STAR elements
  misc_feature (4)..(5): "N" stands for any nucleotide
aggnnggg

SEQ ID NO: 373 - DNA, 11 bp, Artificial Sequence
  Dyad patterns over-represented in STAR elements
  misc_feature (4)..(8): "N" stands for any nucleotide
cacnnnnngcg

SEQ ID NO: 374 - DNA, 23 bp, Artificial Sequence
  Dyad patterns over-represented in STAR elements
  misc_feature (4)..(20): "N" stands for any nucleotide
cgcnnnnnnnnnnnnnnnnncca

SEQ ID NO: 375 - DNA, 15 bp, Artificial Sequence
  Dyad patterns over-represented in STAR elements
  misc_feature (4)..(12): "N" stands for any nucleotide
cccnnnnnnnnnggc

SEQ ID NO: 376 - DNA, 11 bp, Artificial Sequence
  Dyad patterns over-represented in STAR elements
  misc_feature (4)..(8): "N" stands for any nucleotide
cctnnnnngcg

SEQ ID NO: 377 - DNA, 6 bp, Artificial Sequence
  Dyad patterns over-represented in STAR elements
gcggac

SEQ ID NO: 378 - DNA, 6 bp, Artificial Sequence
  Dyad patterns over-represented in STAR elements
gccggc

SEQ ID NO: 379 - DNA, 8 bp, Artificial Sequence
  Dyad patterns over-represented in STAR elements
  misc_feature (4)..(5): "N" stands for any nucleotide
gcgnnccc

SEQ ID NO: 380 - DNA, 17 bp, Artificial Sequence
  Dyad patterns over-represented in STAR elements
  misc_feature (4)..(14): "N" stands for any nucleotide
ccgnnnnnnnnnnnccc

SEQ ID NO: 381 - DNA, 14 bp, Artificial Sequence
  Dyad patterns over-represented in STAR elements
  misc_feature (4)..(11): "N" stands for any nucleotide
cccnnnnnnnntcg

SEQ ID NO: 382 - DNA, 23 bp, Artificial Sequence
  Dyad patterns over-represented in STAR elements
  misc_feature (4)..(20): "N" stands for any nucleotide
ccgnnnnnnnnnnnnnnnnngcc

SEQ ID NO: 383 - DNA, 11 bp, Artificial Sequence
  Dyad patterns over-represented in STAR elements
  misc_feature (4)..(8): "N" stands for any nucleotide
gggnnnnngga

SEQ ID NO: 384 - DNA, 12 bp, Artificial Sequence
  Dyad patterns over-represented in STAR elements
  misc_feature (4)..(9): "N" stands for any nucleotide
ggcnnnnnngga

SEQ ID NO: 385 - DNA, 10 bp, Artificial Sequence
  Dyad patterns over-represented in STAR elements
  misc_feature (4)..(7): "N" stands for any nucleotide
ccannnnccc

SEQ ID NO: 386 - DNA, 20 bp, Artificial Sequence
  Dyad patterns over-represented in STAR elements
  misc_feature (4)..(17): "N" stands for any nucleotide
cctnnnnnnnnnnnnnnccg

SEQ ID NO: 387 - DNA, 18 bp, Artificial Sequence
  Dyad patterns over-represented in STAR elements
  misc_feature (4)..(15): "N" stands for any nucleotide
gacnnnnnnnnnnnnggc

SEQ ID NO: 388 - DNA, 19 bp, Artificial Sequence
  Dyad patterns over-represented in STAR elements
  misc_feature (4)..(16): "N" stands for any nucleotide
cgcnnnnnnnnnnnnnccc

SEQ ID NO: 389 - DNA, 22 bp, Artificial Sequence
  Dyad patterns over-represented in STAR elements
  misc_feature (4)..(19): "N" stands for any nucleotide
cagnnnnnnnnnnnnnnnnccc

SEQ ID NO: 390 - DNA, 16 bp, Artificial Sequence
  Dyad patterns over-represented in STAR elements
  misc_feature (4)..(13): "N" stands for any nucleotide
agcnnnnnnnnnnggg

SEQ ID NO: 391 - DNA, 19 bp, Artificial Sequence
  Dyad patterns over-represented in STAR elements
  misc_feature (4)..(16): "N" stands for any nucleotide
cggnnnnnnnnnnnnnggc

SEQ ID NO: 392 - DNA, 7 bp, Artificial Sequence
  Dyad patterns over-represented in STAR elements
  misc_feature (4)..(4): "N" stands for any nucleotide
cggngcc

SEQ ID NO: 393 - DNA, 6 bp, Artificial Sequence
  Dyad patterns over-represented in STAR elements
agcggc

SEQ ID NO: 394 - DNA, 22 bp, Artificial Sequence
  Dyad patterns over-represented in STAR elements
  misc_feature (4)..(19): "N" stands for any nucleotide
cccnnnnnnnnnnnnnnnnggc

SEQ ID NO: 395 - DNA, 25 bp, Artificial Sequence
  Dyad patterns over-represented in STAR elements
  misc_feature (4)..(22): "N" stands for any nucleotide
gctnnnnnnnnnnnnnnnnnnnccc

SEQ ID NO: 396 - DNA, 22 bp, Artificial Sequence
  Dyad patterns over-represented in STAR elements
  misc_feature (4)..(19): "N" stands for any nucleotide
cccnnnnnnnnnnnnnnnnggg

SEQ ID NO: 397 - DNA, 15 bp, Artificial Sequence
  Dyad patterns over-represented in STAR elements
  misc_feature (4)..(12): "N" stands for any nucleotide
cccnnnnnnnnncgg

SEQ ID NO: 398 - DNA, 16 bp, Artificial Sequence
  Dyad patterns over-represented in STAR elements
  misc_feature (4)..(13): "N" stands for any nucleotide
cccnnnnnnnnnncgg

SEQ ID NO: 399 - DNA, 6 bp, Artificial Sequence
  Dyad patterns over-represented in STAR elements
ccagcg

SEQ ID NO: 400 - DNA, 23 bp, Artificial Sequence
  Dyad patterns over-represented in STAR elements
  misc_feature (4)..(20): "N" stands for any nucleotide
gccnnnnnnnnnnnnnnnnncgc

SEQ ID NO: 401 - DNA, 12 bp, Artificial Sequence
  Dyad patterns over-represented in STAR elements
  misc_feature (4)..(9): "N" stands for any nucleotide
cctnnnnnncgc

SEQ ID NO: 402 - DNA, 7 bp, Artificial Sequence
  Dyad patterns over-represented in STAR elements
  misc_feature (4)..(4): "N" stands for any nucleotide
gganccc

SEQ ID NO: 403 - DNA, 24 bp, Artificial Sequence
  Dyad patterns over-represented in STAR elements
  misc_feature (4)..(21): "N" stands for any nucleotide
cgcnnnnnnnnnnnnnnnnnncac

SEQ ID NO: 404 - DNA, 26 bp, Artificial Sequence
  Dyad patterns over-represented in STAR elements
  misc_feature (4)..(23): "N" stands for any nucleotide
cgcnnnnnnnnnnnnnnnnnnnnccg

SEQ ID NO: 405 - DNA, 6 bp, Artificial Sequence
  Dyad patterns over-represented in STAR elements
ccggca

SEQ ID NO: 406 - DNA, 26 bp, Artificial Sequence
  Dyad patterns over-represented in STAR elements
  misc_feature (4)..(23): "N" stands for any nucleotide
cgcnnnnnnnnnnnnnnnnnnnnccc

SEQ ID NO: 407 - DNA, 21 bp, Artificial Sequence
  Dyad patterns over-represented in STAR elements
  misc_feature (4)..(18): "N" stands for any nucleotide
agcnnnnnnnnnnnnnnnccc

SEQ ID NO: 408 - DNA, 13 bp, Artificial Sequence
  Dyad patterns over-represented in STAR elements
  misc_feature (4)..(10): "N" stands for any nucleotide
cctnnnnnnnggc

SEQ ID NO: 409 - DNA, 11 bp, Artificial Sequence
  Dyad patterns over-represented in STAR elements
  misc_feature (4)..(8): "N" stands for any nucleotide
gccnnnnncgc

SEQ ID NO: 410 - DNA, 20 bp, Artificial Sequence
  Dyad patterns over-represented in STAR elements
  misc_feature (4)..(17): "N" stands for any nucleotide
gccnnnnnnnnnnnnnncgc

SEQ ID NO: 411 - DNA, 17 bp, Artificial Sequence
  Dyad patterns over-represented in STAR elements
  misc_feature (4)..(14): "N" stands for any nucleotide
cagnnnnnnnnnnnccc

SEQ ID NO: 412 - DNA, 22 bp, Artificial Sequence
  Dyad patterns over-represented in STAR elements
  misc_feature (4)..(19): "N" stands for any nucleotide
gggnnnnnnnnnnnnnnnngac

SEQ ID NO: 413 - DNA, 21 bp, Artificial Sequence
  Dyad patterns over-represented in STAR elements
  misc_feature (4)..(18): "N" stands for any nucleotide
cccnnnnnnnnnnnnnnngcg

SEQ ID NO: 414 - DNA, 6 bp, Artificial Sequence
  Dyad patterns over-represented in STAR elements
ccccgc

SEQ ID NO: 415 - DNA, 22 bp, Artificial Sequence
  Dyad patterns over-represented in STAR elements
  misc_feature (4)..(19): "N" stands for any nucleotide
cccnnnnnnnnnnnnnnnnagc

SEQ ID NO: 416 - DNA, 15 bp, Artificial Sequence
  Dyad patterns over-represented in STAR elements
  misc_feature (4)..(12): "N" stands for any nucleotide
aggnnnnnnnnnggg

SEQ ID NO: 417 - DNA, 18 bp, Artificial Sequence
  Dyad patterns over-represented in STAR elements
  misc_feature (4)..(18): "N" stands for any nucleotide
cgcnnnnnnnnnnnnctc

SEQ ID NO: 418 - DNA, 14 bp, Artificial Sequence
  Dyad patterns over-represented in STAR elements
  misc_feature (4)..(11): "N" stands for any nucleotide
cacnnnnnnnncgc

SEQ ID NO: 419 - DNA, 13 bp, Artificial Sequence
  Dyad patterns over-represented in STAR elements
  misc_feature (4)..(10): "N" stands for any nucleotide
ccannnnnnnccg

SEQ ID NO: 420 - DNA, 7 bp, Artificial Sequence
  Dyad patterns over-represented in STAR elements
  misc_feature (4)..(4): "N" stands for any nucleotide
cggngca

SEQ ID NO: 421 - DNA, 20 bp, Artificial Sequence
  Dyad patterns over-represented in STAR elements
  misc_feature (4)..(17): "N" stands for any nucleotide
cgcnnnnnnnnnnnnnnccc

SEQ ID NO: 422 - DNA, 6 bp, Artificial Sequence
  Dyad patterns over-represented in STAR elements
agcccc

SEQ ID NO: 423 - DNA, 19 bp, Artificial Sequence
  Dyad patterns over-represented in STAR elements
  misc_feature (4)..(16): "N" stands for any nucleotide
cgcnnnnnnnnnnnnngtc

SEQ ID NO: 424 - DNA, 9 bp, Artificial Sequence
  Dyad patterns over-represented in STAR elements
  misc_feature (4)..(6): "N" stands for any nucleotide
gcgnnngca

SEQ ID NO: 425 - DNA, 6 bp, Artificial Sequence
  Dyad patterns over-represented in STAR elements
cggggc

SEQ ID NO: 426 - DNA, 20 bp, Artificial Sequence
  Dyad patterns over-represented in STAR elements
  misc_feature (4)..(17): "N" stands for any nucleotide
gccnnnnnnnnnnnnnnccc

SEQ ID NO: 427 - DNA, 13 bp, Artificial Sequence
  Dyad patterns over-represented in STAR elements
  misc_feature (4)..(10): "N" stands for any nucleotide
accnnnnnnncgc

SEQ ID NO: 428 - DNA, 13 bp, Artificial Sequence
  Dyad patterns over-represented in STAR elements
  misc_feature (4)..(10): "N" stands for any nucleotide
aggnnnnnnncgg

SEQ ID NO: 429 - DNA, 22 bp, Artificial Sequence
  Dyad patterns over-represented in STAR elements
  misc_feature (4)..(19): "N" stands for any nucleotide
cccnnnnnnnnnnnnnnnncga

SEQ ID NO: 430 - DNA, 12 bp, Artificial Sequence
  Dyad patterns over-represented in STAR elements
  misc_feature (4)..(9): "N" stands for any nucleotide
cgcnnnnnncag

SEQ ID NO: 431 - DNA, 17 bp, Artificial Sequence
  Dyad patterns over-represented in STAR elements
  misc_feature (4)..(14): "N" stands for any nucleotide
cagnnnnnnnnnnngcg

SEQ ID NO: 432 - DNA, 18 bp, Artificial Sequence
  Dyad patterns over-represented in STAR elements
  misc_feature (4)..(15): "N" stands for any nucleotide
ccgnnnnnnnnnnnnccg

SEQ ID NO: 433 - DNA, 24 bp, Artificial Sequence
  Dyad patterns over-represented in STAR elements
  misc_feature (4)..(21): "N" stands for any nucleotide
cgcnnnnnnnnnnnnnnnnnncag

SEQ ID NO: 434 - DNA, 7 bp, Artificial Sequence
  Dyad patterns over-represented in STAR elements
  misc_feature (4)..(4): "N" stands for any nucleotide
cagnggg

SEQ ID NO: 435 - DNA, 6 bp, Artificial Sequence
  Dyad patterns over-represented in STAR elements
cgcccc

SEQ ID NO: 436 - DNA, 24 bp, Artificial Sequence
  Dyad patterns over-represented in STAR elements
  misc_feature (4)..(21): "N" stands for any nucleotide
gcgnnnnnnnnnnnnnnnnnngcc

SEQ ID NO: 437 - DNA, 21 bp, Artificial Sequence
  Dyad patterns over-represented in STAR elements
  misc_feature (4)..(18): "N" stands for any nucleotide
cggnnnnnnnnnnnnnnnggc

SEQ ID NO: 438 - DNA, 21 bp, Artificial Sequence
  Dyad patterns over-represented in STAR elements
  misc_feature (4)..(18): "N" stands for any nucleotide
cccnnnnnnnnnnnnnnnagg

SEQ ID NO: 439 - DNA, 26 bp, Artificial Sequence
  Dyad patterns over-represented in STAR elements
  misc_feature (4)..(23): "N" stands for any nucleotide
aggnnnnnnnnnnnnnnnnnnnngcg

SEQ ID NO: 440 - DNA, 11 bp, Artificial Sequence
  Dyad patterns over-represented in STAR elements
  misc_feature (4)..(8): "N" stands for any nucleotide
cggnnnnnctc

SEQ ID NO: 441 - DNA, 23 bp, Artificial Sequence
  Dyad patterns over-represented in STAR elements
  misc_feature (4)..(20): "N" stands for any nucleotide
tccnnnnnnnnnnnnnnnnncga

SEQ ID NO: 442 - DNA, 10 bp, Artificial Sequence
  Dyad patterns over-represented in STAR elements
  misc_feature (4)..(7): "N" stands for any nucleotide
gcgnnnnccc

SEQ ID NO: 443 - DNA, 8 bp, Artificial Sequence
  Dyad patterns over-represented in STAR elements
  misc_feature (4)..(5): "N" stands for any nucleotide
cccnncgc

SEQ ID NO: 444 - DNA, 9 bp, Artificial Sequence
  Dyad patterns over-represented in STAR elements
  misc_feature (4)..(6): "N" stands for any nucleotide
cgtnnncag

SEQ ID NO: 445 - DNA, 19 bp, Artificial Sequence
  Dyad patterns over-represented in STAR elements
  misc_feature (4)..(16): "N" stands for any nucleotide
ccgnnnnnnnnnnnnngag

SEQ ID NO: 446 - DNA, 12 bp, Artificial Sequence
  Dyad patterns over-represented in STAR elements
  misc_feature (4)..(9): "N" stands for any nucleotide
ctcnnnnnncgc

SEQ ID NO: 447 - DNA, 10 bp, Artificial Sequence
  Dyad patterns over-represented in STAR elements
  misc_feature (4)..(7): "N" stands for any nucleotide
cgcnnnngag

SEQ ID NO: 448 - DNA, 11 bp, Artificial Sequence
  Dyad patterns over-represented in STAR elements
  misc_feature (4)..(8): "N" stands for any nucleotide
gcgnnnnngga

SEQ ID NO: 449 - DNA, 7 bp, Artificial Sequence
  Dyad patterns over-represented in STAR elements
  misc_feature (4)..(4): "N" stands for any nucleotide
ccgncag

SEQ ID NO: 450 - DNA, 17 bp, Artificial Sequence
  Dyad patterns over-represented in STAR elements
  misc_feature (4)..(14): "N" stands for any nucleotide
cgcnnnnnnnnnnnccg

SEQ ID NO: 451 - DNA, 25 bp, Artificial Sequence
  Dyad patterns over-represented in STAR elements
  misc_feature (4)..(22): "N" stands for any nucleotide
gcgnnnnnnnnnnnnnnnnnnnccc

SEQ ID NO: 452 - DNA, 24 bp, Artificial Sequence
  Dyad patterns over-represented in STAR elements
  misc_feature (4)..(21): "N" stands for any nucleotide
cgcnnnnnnnnnnnnnnnnnngaa

SEQ ID NO: 453 - DNA, 25 bp, Artificial Sequence
  Dyad patterns over-represented in STAR elements
  misc_feature (4)..(22): "N" stands for any nucleotide
gggnnnnnnnnnnnnnnnnnnngga

SEQ ID NO: 454 - DNA, 7 bp, Artificial Sequence
  Dyad patterns over-represented in STAR elements
  misc_feature (4)..(4): "N" stands for any nucleotide
ccancgg

SEQ ID NO: 455 - DNA, 13 bp, Artificial Sequence
  Dyad patterns over-represented in STAR elements
  misc_feature (4)..(10): "N" stands for any nucleotide
cccnnnnnnngcg

SEQ ID NO: 456 - DNA, 16 bp, Artificial Sequence
  Dyad patterns over-represented in STAR elements
  misc_feature (4)..(13): "N" stands for any nucleotide
aggnnnnnnnnnnccc

SEQ ID NO: 457 - DNA, 6 bp, Artificial Sequence
  Dyad patterns over-represented in STAR elements
ccaggg

SEQ ID NO: 458 - DNA, 16 bp, Artificial Sequence
  Dyad patterns over-represented in STAR elements
  misc_feature (4)..(13): "N" stands for any nucleotide
cagnnnnnnnnnnccc

SEQ ID NO: 459 - DNA, 24 bp, Artificial Sequence
  Dyad patterns over-represented in STAR elements
  misc_feature (4)..(21): "N" stands for any nucleotide
ccgnnnnnnnnnnnnnnnnnnccg

SEQ ID NO: 460 - DNA, 24 bp, Artificial Sequence
  Dyad patterns over-represented in STAR elements
  misc_feature (4)..(21): "N" stands for any nucleotide
ccgnnnnnnnnnnnnnnnnnnggc

SEQ ID NO: 461 - DNA, 8 bp, Artificial Sequence
  Dyad patterns over-represented in STAR elements
  misc_feature (4)..(5): "N" stands for any nucleotide
cccnngcg

SEQ ID NO: 462 - DNA, 7 bp, Artificial Sequence
  Dyad patterns over-represented in STAR elements
  misc_feature (4)..(5): "N" stands for any nucleotide
cgcnggc

SEQ ID NO: 463 - DNA, 11 bp, Artificial Sequence
  Dyad patterns over-represented in STAR elements
  misc_feature (4)..(8): "N" stands for any nucleotide
ccgnnnnngac

SEQ ID NO: 464 - DNA, 6 bp, Artificial Sequence
  Dyad patterns over-represented in STAR elements
ggaccc

SEQ ID NO: 465 - DNA, 7 bp, Artificial Sequence
  Dyad patterns over-represented in STAR elements
  misc_feature (4)..(4): "N" stands for any nucleotide
cccnccg

SEQ ID NO: 466 - DNA, 21 bp, Artificial Sequence
  Dyad patterns over-represented in STAR elements
  misc_feature (4)..(18): "N" stands for any nucleotide
cccnnnnnnnnnnnnnnnacg

SEQ ID NO: 467 - DNA, 14 bp, Artificial Sequence
  Dyad patterns over-represented in STAR elements
  misc_feature (4)..(11): "N" stands for any nucleotide
agcnnnnnnnnccc

SEQ ID NO: 468 - DNA, 9 bp, Artificial Sequence
  Dyad patterns over-represented in STAR elements
  misc_feature (4)..(6): "N" stands for any nucleotide
cccnnnggc

SEQ ID NO: 469 - DNA, 15 bp, Artificial Sequence
  Dyad patterns over-represented in STAR elements
  misc_feature (4)..(12): "N" stands for any nucleotide
aggnnnnnnnnncgg

SEQ ID NO: 470 - DNA, 20 bp, Artificial Sequence
  Dyad patterns over-represented in STAR elements
  misc_feature (4)..(17): "N" stands for any nucleotide
cccnnnnnnnnnnnnnncgc

SEQ ID NO: 471 - DNA, 6 bp, Artificial Sequence
  Dyad patterns over-represented in STAR elements
ccgccg

SEQ ID NO: 472 - DNA, 14 bp, Artificial Sequence
  Dyad patterns over-represented in STAR elements
  misc_feature (4)..(11): "N" stands for any nucleotide
cgcnnnnnnnnagc

SEQ ID NO: 473 - DNA, 25 bp, Artificial Sequence
  Dyad patterns over-represented in STAR elements
  misc_feature (4)..(22): "N" stands for any nucleotide
cgcnnnnnnnnnnnnnnnnnnnacc

SEQ ID NO: 474 - DNA, 23 bp, Artificial Sequence
  Dyad patterns over-represented in STAR elements
  misc_feature (4)..(20): "N" stands for any nucleotide
gcgnnnnnnnnnnnnnnnnngac

SEQ ID NO: 475 - DNA, 7 bp, Artificial Sequence
  Dyad patterns over-represented in STAR elements
  misc_feature (4)..(4): "N" stands for any nucleotide
agcngcg

SEQ ID NO: 476 - DNA, 17 bp, Artificial Sequence
  Dyad patterns over-represented in STAR elements
  misc_feature (4)..(14): "N" stands for any nucleotide
ccgnnnnnnnnnnnggc

SEQ ID NO: 477 - DNA, 10 bp, Artificial Sequence
  Dyad patterns over-represented in STAR elements
  misc_feature (4)..(7): "N" stands for any nucleotide
cggnnnnaga

SEQ ID NO: 478 - DNA, 20 bp, Artificial Sequence
  Dyad patterns over-represented in STAR elements
  misc_feature (4)..(17): "N" stands for any nucleotide
cgcnnnnnnnnnnnnnnccg

SEQ ID NO: 479 - DNA, 26 bp, Artificial Sequence
  Dyad patterns over-represented in STAR elements
  misc_feature (4)..(23): "N" stands for any nucleotide
cctnnnnnnnnnnnnnnnnnnnngcg

SEQ ID NO: 480 - DNA, 16 bp, Artificial Sequence
  Dyad patterns over-represented in STAR elements
  misc_feature (4)..(13): "N" stands for any nucleotide
ccannnnnnnnnncgc

SEQ ID NO: 481 - DNA, 26 bp, Artificial Sequence
  Dyad patterns over-represented in STAR elements
  misc_feature (4)..(23): "N" stands for any nucleotide
cccnnnnnnnnnnnnnnnnnnnncac

SEQ ID NO: 482 - DNA, 17 bp, Artificial Sequence
  Dyad patterns over-represented in STAR elements
  misc_feature (4)..(14): "N" stands for any nucleotide
ccgnnnnnnnnnnngcc

SEQ ID NO: 483 - DNA, 24 bp, Artificial Sequence
  Dyad patterns over-represented in STAR elements
  misc_feature (4)..(21): "N" stands for any nucleotide
cgcnnnnnnnnnnnnnnnnnnccc

SEQ ID NO: 484 - DNA, 21 bp, Artificial Sequence
  Dyad patterns over-represented in STAR elements
  misc_feature (4)..(18): "N" stands for any nucleotide
cggnnnnnnnnnnnnnnncgc

SEQ ID NO: 485 - DNA, 22 bp, Artificial Sequence
  Dyad patterns over-represented in STAR elements
  misc_feature (4)..(19): "N" stands for any nucleotide
cgcnnnnnnnnnnnnnnnngcc

SEQ ID NO: 486 - DNA, 26 bp, Artificial Sequence
  Dyad patterns over-represented in STAR elements
  misc_feature (4)..(23): "N" stands for any nucleotide
cgcnnnnnnnnnnnnnnnnnnnnggc

SEQ ID NO: 487 - DNA, 25 bp, Artificial Sequence
  Dyad patterns over-represented in STAR elements
  misc_feature (4)..(22): "N" stands for any nucleotide
cgcnnnnnnnnnnnnnnnnnnnccg

SEQ ID NO: 488 - DNA, 16 bp, Artificial Sequence
  Dyad patterns over-represented in STAR elements
  misc_feature (4)..(13): "N" stands for any nucleotide
cggnnnnnnnnnncca

SEQ ID NO: 489 - DNA, 23 bp, Artificial Sequence
  Dyad patterns over-represented in STAR elements
  misc_feature (4)..(20): "N" stands for any nucleotide
cgcnnnnnnnnnnnnnnnnnccc

SEQ ID NO: 490 - DNA, 17 bp, Artificial Sequence
  Dyad patterns over-represented in STAR elements
  misc_feature (4)..(14): "N" stands for any nucleotide
cgcnnnnnnnnnnnaca

SEQ ID NO: 491 - DNA, 6 bp, Artificial Sequence
  Dyad patterns over-represented in STAR elements
cggacc

SEQ ID NO: 492 - DNA, 16 bp, Artificial Sequence
  Dyad patterns over-represented in STAR elements
  misc_feature (4)..(13): "N" stands for any nucleotide
gcgnnnnnnnnnngcc

SEQ ID NO: 493 - DNA, 14 bp, Artificial Sequence
  Dyad patterns over-represented in STAR elements
  misc_feature (4)..(11): "N" stands for any nucleotide
gcgnnnnnnnngac

SEQ ID NO: 494 - DNA, 21 bp, Artificial Sequence
  Dyad patterns over-represented in STAR elements
  misc_feature (4)..(18): "N" stands for any nucleotide
cccnnnnnnnnnnnnnnnggg

SEQ ID NO: 495 - DNA, 22 bp, Artificial Sequence
  Dyad patterns over-represented in STAR elements
  misc_feature (1)..(19): "N" stands for any nucleotide
cggnnnnnnnnnnnnnnnnggc

SEQ ID NO: 496 - DNA, 22 bp, Artificial Sequence
  Dyad patterns over-represented in STAR elements
  misc_feature (4)..(19): "N" stands for any nucleotide
cgcnnnnnnnnnnnnnnnncca

SEQ ID NO: 497 - DNA, 9 bp, Artificial Sequence
  Dyad patterns over-represented in STAR elements
  misc_feature (4)..(6): "N" stands for any nucleotide
gccnnnccc

SEQ ID NO: 498 - DNA, 10 bp, Artificial Sequence
  Dyad patterns over-represented in STAR elements
  misc_feature (4)..(7): "N" stands for any nucleotide
cagnnnnggg

SEQ ID NO: 499 - DNA, 12 bp, Artificial Sequence
  Dyad patterns over-represented in STAR elements
  misc_feature (4)..(9): "N" stands for any nucleotide
cccnnnnnngcg

SEQ ID NO: 500 - DNA, 22 bp, Artificial Sequence
  Dyad patterns over-represented in STAR elements
  misc_feature (4)..(19): "N" stands for any nucleotide
ccgnnnnnnnnnnnnnnnncgc

SEQ ID NO: 501 - DNA, 23 bp, Artificial Sequence
  Dyad patterns over-represented in STAR elements
  misc_feature (4)..(20): "N" stands for any nucleotide
cccnnnnnnnnnnnnnnnnngca

SEQ ID NO: 502 - DNA, 19 bp, Artificial Sequence
  Dyad patterns over-represented in STAR elements
  misc_feature (4)..(16): "N" stands for any nucleotide
cgcnnnnnnnnnnnnntcc

SEQ ID NO: 503 - DNA, 7 bp, Artificial Sequence
  Dyad patterns over-represented in STAR elements
  misc_feature (4)..(4): "N" stands for any nucleotide
gccncgc

SEQ ID NO: 504 - DNA, 25 bp, Artificial Sequence
  Dyad patterns over-represented in STAR elements
  misc_feature (4)..(22): "N" stands for any nucleotide
ccgnnnnnnnnnnnnnnnnnnngag

SEQ ID NO: 505 - DNA, 16 bp, Artificial Sequence
  Dyad patterns over-represented in STAR elements
  misc_feature (4)..(13): "N" stands for any nucleotide
gggnnnnnnnnnngga

SEQ ID NO: 506 - DNA, 11 bp, Artificial Sequence
  Dyad patterns over-represented in STAR elements
  misc_feature (4)..(8): "N" stands for any nucleotide
cagnnnnnccg

SEQ ID NO: 507 - DNA, 9 bp, Artificial Sequence
  Dyad patterns over-represented in STAR elements
  misc_feature (4)..(6): "N" stands for any nucleotide
cgcnnnaga

SEQ ID NO: 508 - DNA, 6 bp, Artificial Sequence
  Dyad patterns over-represented in STAR elements
gccgcc

SEQ ID NO: 509 - DNA, 14 bp, Artificial Sequence
  Dyad patterns over-represented in STAR elements
  misc_feature (4)..(11): "N" stands for any nucleotide
cccnnnnnnnnggc

SEQ ID NO: 510 - DNA, 12 bp, Artificial Sequence
  Dyad patterns over-represented in STAR elements
  misc_feature (4)..(9): "N" stands for any nucleotide
cctnnnnnngcg

SEQ ID NO: 511 - DNA, 12 bp, Artificial Sequence
  Dyad patterns over-represented in STAR elements
  misc_feature (4)..(9): "N" stands for any nucleotide
gacnnnnnnccc

SEQ ID NO: 512 - DNA, 7 bp, Artificial Sequence
  Dyad patterns over-represented in STAR elements
  misc_feature (4)..(4): "N" stands for any nucleotide
cggnccc

SEQ ID NO: 513 - DNA, 21 bp, Artificial Sequence
  Dyad patterns over-represented in STAR elements
  misc_feature (4)..(18): "N" stands for any nucleotide
cccnnnnnnnnnnnnnnnccg

SEQ ID NO: 514 - DNA, 15 bp, Artificial Sequence
  Dyad patterns over-represented in STAR elements
  misc_feature (4)..(12): "N" stands for any nucleotide
cagnnnnnnnnnccc

SEQ ID NO: 515 - DNA, 16 bp, Artificial Sequence
  Dyad patterns over-represented in STAR elements
  misc_feature (4)..(13): "N" stands for any nucleotide
cggnnnnnnnnnnggc

SEQ ID NO: 516 - DNA, 16 bp, Artificial Sequence
  Dyad patterns over-represented in STAR elements
  misc_feature (4)..(13): "N" stands for any nucleotide
cgannnnnnnnnnacg

SEQ ID NO: 517 - DNA, 9 bp, Artificial Sequence
  Dyad patterns over-represented in STAR elements
  misc_feature (4)..(6): "N" stands for any nucleotide
gcgnnntcc

SEQ ID NO: 518 - DNA, 9 bp, Artificial Sequence
  Dyad patterns over-represented in STAR elements
  misc_feature (4)..(6): "N" stands for any nucleotide
cccnnngcc

SEQ ID NO: 519 - DNA, 7 bp, Artificial Sequence
  Dyad patterns over-represented in STAR elements
  misc_feature (4)..(4): "N" stands for any nucleotide
gcgnacc

SEQ ID NO: 520 - DNA, 15 bp, Artificial Sequence
  Dyad patterns over-represented in STAR elements
  misc_feature (4)..(12): "N" stands for any nucleotide
ccgnnnnnnnnnagg

SEQ ID NO: 521 - DNA, 22 bp, Artificial Sequence
  Dyad patterns over-represented in STAR elements
  misc_feature (4)..(19): "N" stands for any nucleotide
cgcnnnnnnnnnnnnnnnncag

SEQ ID NO: 522 - DNA, 6 bp, Artificial Sequence
  Dyad patterns over-represented in STAR elements
ggcccc

SEQ ID NO: 523 - DNA, 18 bp, Artificial Sequence
  Dyad patterns over-represented in STAR elements
  misc_feature (4)..(15): "N" stands for any nucleotide
aggnnnnnnnnnnnnccg

SEQ ID NO: 524 - DNA, 6 bp, Artificial Sequence
  Dyad patterns over-represented in STAR elements
ccggcg

SEQ ID NO: 525 - DNA, 8 bp, Artificial Sequence
  Dyad patterns over-represented in STAR elements
  misc_feature (4)..(5): "N" stands for any nucleotide
ccgnngcc

SEQ ID NO: 526 - DNA, 17 bp, Artificial Sequence
  Dyad patterns over-represented in STAR elements
  misc_feature (4)..(14): "N" stands for any nucleotide
ccgnnnnnnnnnnngtc

SEQ ID NO: 527 - DNA, 6 bp, Artificial Sequence
  Dyad patterns over-represented in STAR elements
cagccc

SEQ ID NO: 528 - DNA, 11 bp, Artificial Sequence
  Dyad patterns over-represented in STAR elements
  misc_feature (4)..(8): "N" stands for any nucleotide
cccnnnnnccg

SEQ ID NO: 529 - DNA, 26 bp, Artificial Sequence
  Dyad patterns over-represented in STAR elements
  misc_feature (4)..(23): "N" stands for any nucleotide
gccnnnnnnnnnnnnnnnnnnnnccc

SEQ ID NO: 530 - DNA, 8 bp, Artificial Sequence
  Dyad patterns over-represented in STAR elements
  misc_feature (4)..(5): "N" stands for any nucleotide
gacnncgc

SEQ ID NO: 531 - DNA, 12 bp, Artificial Sequence
  Dyad patterns over-represented in STAR elements
  misc_feature (4)..(9): "N" stands for any nucleotide
cgcnnnnnncac

SEQ ID NO: 532 - DNA, 20 bp, Artificial Sequence
  Dyad patterns over-represented in STAR elements
  misc_feature (4)..(17): "N" stands for any nucleotide
aggnnnnnnnnnnnnnngcg

SEQ ID NO: 533 - DNA, 11 bp, Artificial Sequence
  Dyad patterns over-represented in STAR elements
  misc_feature (4)..(8): "N" stands for any nucleotide
gacnnnnncgc

SEQ ID NO: 534 - DNA, 25 bp, Artificial Sequence
  Dyad patterns over-represented in STAR elements
  misc_feature (4)..(22): "N" stands for any nucleotide
cctnnnnnnnnnnnnnnnnnnnccg

SEQ ID NO: 535 - DNA, 18 bp, Artificial Sequence
  Dyad patterns over-represented in STAR elements
  misc_feature (4)..(15): "N" stands for any nucleotide
ccgnnnnnnnnnnnngga

SEQ ID NO: 536 - DNA, 15 bp, Artificial Sequence
  Dyad patterns over-represented in STAR elements
  misc_feature (4)..(12): "N" stands for any nucleotide
ggcnnnnnnnnngac

SEQ ID NO: 537 - DNA, 16 bp, Artificial Sequence
  Dyad patterns over-represented in STAR elements
  misc_feature (4)..(13): "N" stands for any nucleotide
aggnnnnnnnnnnggg

SEQ ID NO: 538 - DNA, 16 bp, Artificial Sequence
  Dyad patterns over-represented in STAR elements
  misc_feature (4)..(13): "N" stands for any nucleotide
ccgnnnnnnnnnngag

SEQ ID NO: 539 - DNA, 12 bp, Artificial Sequence
  Dyad patterns over-represented in STAR elements
  misc_feature (4)..(9): "N" stands for any nucleotide
cgcnnnnnngga

SEQ ID NO: 540 - DNA, 13 bp, Artificial Sequence
  Dyad patterns over-represented in STAR elements
  misc_feature (4)..(10): "N" stands for any nucleotide
cgcnnnnnnnagc

SEQ ID NO: 541 - DNA, 19 bp, Artificial Sequence
  Dyad patterns over-represented in STAR elements
  misc_feature (4)..(16): "N" stands for any nucleotide
ccannnnnnnnnnnnncgg

SEQ ID NO: 542 - DNA, 12 bp, Artificial Sequence
  Dyad patterns over-represented in STAR elements
  misc_feature (4)..(9): "N" stands for any nucleotide
cggnnnnnngga

SEQ ID NO: 543 - DNA, 25 bp, Artificial Sequence
  Dyad patterns over-represented in STAR elements
  misc_feature (4)..(22): "N" stands for any nucleotide
cgcnnnnnnnnnnnnnnnnnnngcc

SEQ ID NO: 544 - DNA, 18 bp, Artificial Sequence
  Dyad patterns over-represented in STAR elements
  misc_feature (4)..(15): "N" stands for any nucleotide
ccannnnnnnnnnnncgc

SEQ ID NO: 545 - DNA, 7 bp, Artificial Sequence
  Dyad patterns over-represented in STAR elements
  misc_feature (4)..(4): "N" stands for any nucleotide
cggnggc

SEQ ID NO: 546 - DNA, 9 bp, Artificial Sequence
  Dyad patterns over-represented in STAR elements
  misc_feature (4)..(6): "N" stands for any nucleotide
gcgnnncca

SEQ ID NO: 547 - DNA, 7 bp, Artificial Sequence
  Dyad patterns over-represented in STAR elements
  misc_feature (4)..(4): "N" stands for any nucleotide
aggncgc

SEQ ID NO: 548 - DNA, 11 bp, Artificial Sequence
  Dyad patterns over-represented in STAR elements
  misc_feature (4)..(8): "N" stands for any nucleotide
ctcnnnnncgc

SEQ ID NO: 549 - DNA, 6 bp, Artificial Sequence
  Dyad patterns over-represented in STAR elements
cccacg

SEQ ID NO: 550 - DNA, 23 bp, Artificial Sequence
  Dyad patterns over-represented in STAR elements
  misc_feature (4)..(20): "N" stands for any nucleotide
cagnnnnnnnnnnnnnnnnnccg

SEQ ID NO: 551 - DNA, 10 bp, Artificial Sequence
  Dyad patterns over-represented in STAR elements
  misc_feature (4)..(7): "N" stands for any nucleotide
ggcnnnnccc

SEQ ID NO: 552 - DNA, 14 bp, Artificial Sequence
  Dyad patterns over-represented in STAR elements
  misc_feature (4)..(11): "N" stands for any nucleotide
aggnnnnnnnngcg

SEQ ID NO: 553 - DNA, 7 bp, Artificial Sequence
  Dyad patterns over-represented in STAR elements
  misc_feature (4)..(4): "N" stands for any nucleotide
ctgnccc

SEQ ID NO: 554 - DNA, 22 bp, Artificial Sequence
  Dyad patterns over-represented in STAR elements
  misc_feature (4)..(19): "N" stands for any nucleotide
cccnnnnnnnnnnnnnnnncag

SEQ ID NO: 555 - DNA, 15 bp, Artificial Sequence
  Dyad patterns over-represented in STAR elements
  misc_feature (4)..(12): "N" stands for any nucleotide
cgcnnnnnnnnngac

SEQ ID NO: 556 - DNA, 12 bp, Artificial Sequence
  Dyad patterns over-represented in STAR elements
  misc_feature (4)..(9): "N" stands for any nucleotide
cagnnnnnnccg

SEQ ID NO: 557 - DNA, 18 bp, Artificial Sequence
  Dyad patterns over-represented in STAR elements
  misc_feature (4)..(15): "N" stands for any nucleotide
cgtnnnnnnnnnnnncgc

SEQ ID NO: 558 - DNA, 13 bp, Artificial Sequence
  Dyad patterns over-represented in STAR elements
  misc_feature (4)..(10): "N" stands for any nucleotide
ctcnnnnnnngcc

SEQ ID NO: 559 - DNA, 25 bp, Artificial Sequence
  Dyad patterns over-represented in STAR elements
  misc_feature (4)..(22): "N" stands for any nucleotide
cgcnnnnnnnnnnnnnnnnnnntcc

SEQ ID NO: 560 - DNA, 13 bp, Artificial Sequence
  Dyad patterns over-represented in STAR elements
  misc_feature (4)..(10): "N" stands for any nucleotide
cccnnnnnnngcc

SEQ ID NO: 561 - DNA, 19 bp, Artificial Sequence
  Dyad patterns over-represented in STAR elements
  misc_feature (4)..(16): "N" stands for any nucleotide
cagnnnnnnnnnnnnncgg

SEQ ID NO: 562 - DNA, 7 bp, Artificial Sequence
  Dyad patterns over-represented in STAR elements
  misc_feature (4)..(4): "N" stands for any nucleotide
cgcngcc

SEQ ID NO: 563 - DNA, 23 bp, Artificial Sequence
  Dyad patterns over-represented in STAR elements
  misc_feature (4)..(20): "N" stands for any nucleotide
cgcnnnnnnnnnnnnnnnnnccg

SEQ ID NO: 564 - DNA, 10 bp, Artificial Sequence
  Dyad patterns over-represented in STAR elements
  misc_feature (4)..(7): "N" stands for any nucleotide
aggnnnnccc

SEQ ID NO: 565 - DNA, 16 bp, Artificial Sequence
  Dyad patterns over-represented in STAR elements
  misc_feature (4)..(13): "N" stands for any nucleotide
agcnnnnnnnnnncgc

SEQ ID NO: 566 - DNA, 17 bp, Artificial Sequence
  Dyad patterns over-represented in STAR elements
  misc_feature (4)..(14): "N" stands for any nucleotide
cccnnnnnnnnnnncgg

SEQ ID NO: 567 - DNA, 14 bp, Artificial Sequence
  Dyad patterns over-represented in STAR elements
  misc_feature (4)..(11): "N" stands for any nucleotide
cccnnnnnnnngcc

SEQ ID NO: 568 - DNA, 7 bp, Artificial Sequence
  Dyad patterns over-represented in STAR elements
  misc_feature (4)..(4): "N" stands for any nucleotide
ccgncgg

SEQ ID NO: 569 - DNA, 7 bp, Artificial Sequence
  Dyad patterns over-represented in STAR elements
  misc_feature (4)..(4): "N" stands for any nucleotide
cccnacc

SEQ ID NO: 570 - DNA, 6 bp, Artificial Sequence
  Dyad patterns over-represented in STAR elements
cgccag

SEQ ID NO: 571 - DNA, 25 bp, Artificial Sequence
  Dyad patterns over-represented in STAR elements
  misc_feature (4)..(22): "N" stands for any nucleotide
ccgnnnnnnnnnnnnnnnnnnntgc

SEQ ID NO: 572 - DNA, 10 bp, Artificial Sequence
  Dyad patterns over-represented in STAR elements
  misc_feature (4)..(7): "N" stands for any nucleotide
gcgnnnncga

SEQ ID NO: 573 - DNA, 25 bp, Artificial Sequence
  Dyad patterns over-represented in STAR elements
  misc_feature (4)..(22): "N" stands for any nucleotide
ccgnnnnnnnnnnnnnnnnnnngcc

SEQ ID NO: 574 - DNA, 16 bp, Artificial Sequence
  Dyad patterns over-represented in STAR elements
  misc_feature (4)..(13): "N" stands for any nucleotide
ccannnnnnnnnnccc

SEQ ID NO: 575 - DNA, 19 bp, Artificial Sequence
  Dyad patterns over-represented in STAR elements
  misc_feature (4)..(16): "N" stands for any nucleotide
cagnnnnnnnnnnnnnggg

SEQ ID NO: 576 - DNA, 24 bp, Artificial Sequence
  Dyad patterns over-represented in STAR elements
  misc_feature (4)..(21): "N" stands for any nucleotide
agcnnnnnnnnnnnnnnnnnncgg

SEQ ID NO: 577 - DNA, 14 bp, Artificial Sequence
  Dyad patterns over-represented in STAR elements
  misc_feature (4)..(11): "N" stands for any nucleotide
cgannnnnnnncgc

SEQ ID NO: 578 - DNA, 10 bp, Artificial Sequence
  Dyad patterns over-represented in STAR elements
  misc_feature (4)..(7): "N" stands for any nucleotide
agcnnnnccc

SEQ ID NO: 579 - DNA, 12 bp, Artificial Sequence
  Dyad patterns over-represented in STAR elements
  misc_feature (4)..(9): "N" stands for any nucleotide
ggannnnnnccc

SEQ ID NO: 580 - DNA, 19 bp, Artificial Sequence
  Dyad patterns over-represented in STAR elements
  misc_feature (4)..(16): "N" stands for any nucleotide
cggnnnnnnnnnnnnnaag

SEQ ID NO: 581 - DNA, 17 bp, Artificial Sequence
  Dyad patterns over-represented in STAR elements
  misc_feature (4)..(14): "N" stands for any nucleotide
accnnnnnnnnnnncgc

SEQ ID NO: 582 - DNA, 18 bp, Artificial Sequence
  Dyad patterns over-represented in STAR elements
  misc_feature (4)..(15): "N" stands for any nucleotide
ccgnnnnnnnnnnnncag

SEQ ID NO: 583 - DNA, 18 bp, Artificial Sequence
  Dyad patterns over-represented in STAR elements
  misc_feature (4)..(15): "N" stands for any nucleotide
cccnnnnnnnnnnnnggg

SEQ ID NO: 584 - DNA, 23 bp, Artificial Sequence
  Dyad patterns over-represented in STAR elements
  misc_feature (4)..(20): "N" stands for any nucleotide
cacnnnnnnnnnnnnnnnnnacg

SEQ ID NO: 585 - DNA, 24 bp, Artificial Sequence
  Dyad patterns over-represented in STAR elements
  misc_feature (4)..(21): "N" stands for any nucleotide
cagnnnnnnnnnnnnnnnnnnccc

SEQ ID NO: 586 - DNA, 16 bp, Artificial Sequence
  Dyad patterns over-represented in STAR elements
  misc_feature (4)..(13): "N" stands for any nucleotide
cgtnnnnnnnnnngtc

SEQ ID NO: 587 - DNA, 19 bp, Artificial Sequence
  Dyad patterns over-represented in STAR elements
  misc_feature (4)..(16): "N" stands for any nucleotide
cccnnnnnnnnnnnnngcg

SEQ ID NO: 588 - DNA, 7 bp, Artificial Sequence
  Dyad patterns over-represented in STAR elements
  misc_feature (4)..(4): "N" stands for any nucleotide
gcancgc

SEQ ID NO: 589 - DNA, 10 bp, Artificial Sequence
  Dyad patterns over-represented in STAR elements
  misc_feature (4)..(7): "N" stands for any nucleotide
agannnnccg

SEQ ID NO: 590 - DNA, 16 bp, Artificial Sequence
  Dyad patterns over-represented in STAR elements
  misc_feature (4)..(13): "N" stands for any nucleotide
gcgnnnnnnnnnnagc

SEQ ID NO: 591 - DNA, 6 bp, Artificial Sequence
  Dyad patterns over-represented in STAR elements
cgcgga

SEQ ID NO: 592 - DNA, 10 bp, Artificial Sequence
  Dyad patterns over-represented in STAR elements
  misc_feature (4)..(7): "N" stands for any nucleotide
cggnnnngac

SEQ ID NO: 593 - DNA, 18 bp, Artificial Sequence
  Dyad patterns over-represented in STAR elements
  misc_feature (4)..(15): "N" stands for any nucleotide
cccnnnnnnnnnnnncgc

SEQ ID NO: 594 - DNA, 21 bp, Artificial Sequence
  Dyad patterns over-represented in STAR elements
  misc_feature (4)..(18): "N" stands for any nucleotide
gccnnnnnnnnnnnnnnnccc

SEQ ID NO: 595 - DNA, 12 bp, Artificial Sequence
  Dyad patterns over-represented in STAR elements
  misc_feature (4)..(9): "N" stands for any nucleotide
gcgnnnnnntcc

SEQ ID NO: 596 - DNA, 9 bp, Artificial Sequence
  Dyad patterns over-represented in STAR elements
  misc_feature (4)..(6): "N" stands for any nucleotide
cggnnncag

SEQ ID NO: 597 - DNA, 9 bp, Artificial Sequence
  Dyad patterns over-represented in STAR elements
  misc_feature (4)..(6): "N" stands for any nucleotide
cccnnncca

SEQ ID NO: 598 - DNA, 9 bp, Artificial Sequence
  Dyad patterns over-represented in STAR elements
  misc_feature (4)..(6): "N" stands for any nucleotide
agcnnnccc

SEQ ID NO: 599 - DNA, 22 bp, Artificial Sequence
  Dyad patterns over-represented in STAR elements
  misc_feature (4)..(19): "N" stands for any nucleotide
gggnnnnnnnnnnnnnnnngca

SEQ ID NO: 600 - DNA, 14 bp, Artificial Sequence
  Dyad patterns over-represented in STAR elements
  misc_feature (4)..(11): "N" stands for any nucleotide
aggnnnnnnnnccg

SEQ ID NO: 601 - DNA, 6 bp, Artificial Sequence
  Dyad patterns over-represented in STAR elements
cccccg

SEQ ID NO: 602 - DNA, 11 bp, Artificial Sequence
  Dyad patterns over-represented in STAR elements
  misc_feature (4)..(8): "N" stands for any nucleotide
gcgnnnnngac

SEQ ID NO: 603 - DNA, 15 bp, Artificial Sequence
  Dyad patterns over-represented in STAR elements
  misc_feature (4)..(12): "N" stands for any nucleotide
cccnnnnnnnnnacc

SEQ ID NO: 604 - DNA, 11 bp, Artificial Sequence
  Dyad patterns over-represented in STAR elements
  misc_feature (4)..(8): "N" stands for any nucleotide
ctgnnnnncgc

SEQ ID NO: 605 - DNA, 20 bp, Artificial Sequence
  Dyad patterns over-represented in STAR elements
  misc_feature (4)..(17): "N" stands for any nucleotide
cgcnnnnnnnnnnnnnnctc

SEQ ID NO: 606 - DNA, 20 bp, Artificial Sequence
  Dyad patterns over-represented in STAR elements
  misc_feature (4)..(17): "N" stands for any nucleotide
cggnnnnnnnnnnnnnngca

SEQ ID NO: 607 - DNA, 14 bp, Artificial Sequence
  Dyad patterns over-represented in STAR elements
  misc_feature (4)..(11): "N" stands for any nucleotide
ccgnnnnnnnngcc

SEQ ID NO: 608 - DNA, 13 bp, Artificial Sequence
  Dyad patterns over-represented in STAR elements
  misc_feature (4)..(10): "N" stands for any nucleotide
ccgnnnnnnncac

SEQ ID NO: 609 - DNA, 14 bp, Artificial Sequence
  Dyad patterns over-represented in STAR elements
  misc_feature (4)..(11): "N" stands for any nucleotide
agcnnnnnnnngcg

SEQ ID NO: 610 - DNA, 22 bp, Artificial Sequence
  Dyad patterns over-represented in STAR elements
  misc_feature (4)..(19): "N" stands for any nucleotide
cggnnnnnnnnnnnnnnnngga

SEQ ID NO: 611 - DNA, 18 bp, Artificial Sequence
  Dyad patterns over-represented in STAR elements
  misc_feature (4)..(15): "N" stands for any nucleotide
ccannnnnnnnnnnnccg

SEQ ID NO: 612 - DNA, 8 bp, Artificial Sequence
  Dyad patterns over-represented in STAR elements
  misc_feature (4)..(5): "N" stands for any nucleotide
cggnnccc

SEQ ID NO: 613 - DNA, 19 bp, Artificial Sequence
  Dyad patterns over-represented in STAR elements
  misc_feature (4)..(16): "N" stands for any nucleotide
ccannnnnnnnnnnnnggg

SEQ ID NO: 614 - DNA, 21 bp, Artificial Sequence
  Dyad patterns over-represented in STAR elements
  misc_feature (4)..(18): "N" stands for any nucleotide
cggnnnnnnnnnnnnnnngca

SEQ ID NO: 615 - DNA, 15 bp, Artificial Sequence
  Dyad patterns over-represented in STAR elements
  misc_feature (4)..(12): "N" stands for any nucleotide
cgcnnnnnnnnngca

SEQ ID NO: 616 - DNA, 25 bp, Artificial Sequence
  Dyad patterns over-represented in STAR elements
  misc_feature (4)..(22): "N" stands for any nucleotide
cggnnnnnnnnnnnnnnnnnnncca

SEQ ID NO: 617 - DNA, 21 bp, Artificial Sequence
  Dyad patterns over-represented in STAR elements
  misc_feature (4)..(18): "N" stands for any nucleotide
gggnnnnnnnnnnnnnnncga

SEQ ID NO: 618 - DNA, 16 bp, Artificial Sequence
  Dyad patterns over-represented in STAR elements
  misc_feature (4)..(13): "N" stands for any nucleotide
cccnnnnnnnnnncgc

SEQ ID NO: 619 - DNA, 20 bp, Artificial Sequence
  Dyad patterns over-represented in STAR elements
  misc_feature (4)..(17): "N" stands for any nucleotide
ctcnnnnnnnnnnnnnncgc

SEQ ID NO: 620 - DNA, 17 bp, Artificial Sequence
  Dyad patterns over-represented in STAR elements
  misc_feature (4)..(14): "N" stands for any nucleotide
cacnnnnnnnnnnngcg

SEQ ID NO: 621 - DNA, 8 bp, Artificial Sequence
  Dyad patterns over-represented in STAR elements
  misc_feature (4)..(5): "N" stands for any nucleotide
ccgnnggc

SEQ ID NO: 622 - DNA, 24 bp, Artificial Sequence
  Dyad patterns over-represented in STAR elements
  misc_feature (4)..(21): "N" stands for any nucleotide
ctgnnnnnnnnnnnnnnnnnnccc

SEQ ID NO: 623 - DNA, 19 bp, Artificial Sequence
  Dyad patterns over-represented in STAR elements
  misc_feature (4)..(16): "N" stands for any nucleotide
gggnnnnnnnnnnnnncac

SEQ ID NO: 624 - DNA, 21 bp, Artificial Sequence
  Dyad patterns over-represented in STAR elements
  misc_feature (4)..(18): "N" stands for any nucleotide
cctnnnnnnnnnnnnnnnggc

SEQ ID NO: 625 - DNA, 26 bp, Artificial Sequence
  Dyad patterns over-represented in STAR elements
  misc_feature (4)..(23): "N" stands for any nucleotide
cccnnnnnnnnnnnnnnnnnnnncga

SEQ ID NO: 626 - DNA, 14 bp, Artificial Sequence
  Dyad patterns over-represented in STAR elements
  misc_feature (4)..(11): "N" stands for any nucleotide
cccnnnnnnnncga

SEQ ID NO: 627 - DNA, 13 bp, Artificial Sequence
  Dyad patterns over-represented in STAR elements
  misc_feature (4)..(10): "N" stands for any nucleotide
gagnnnnnnnccc

SEQ ID NO: 628 - DNA, 8 bp, Artificial Sequence
  Dyad patterns over-represented in STAR elements
  misc_feature (4)..(5): "N" stands for any nucleotide
cgcnnccg

SEQ ID NO: 629 - DNA, 6 bp, Artificial Sequence
  Dyad patterns over-represented in STAR elements
ccctcc

SEQ ID NO: 630 - DNA, 6 bp, Artificial Sequence
  Dyad patterns over-represented in STAR elements
agcgcc

SEQ ID NO: 631 - DNA, 8 bp, Artificial Sequence
  Dyad patterns over-represented in STAR elements
  misc_feature (4)..(5): "N" stands for any nucleotide
cccnntcc

SEQ ID NO: 632 - DNA, 11 bp, Artificial Sequence
  Dyad patterns over-represented in STAR elements
  misc_feature (4)..(8): "N" stands for any nucleotide
ccgnnnnnccc

SEQ ID NO: 633 - DNA, 19 bp, Artificial Sequence
  Dyad patterns over-represented in STAR elements
  misc_feature (4)..(16): "N" stands for any nucleotide
cgcnnnnnnnnnnnnncgc

SEQ ID NO: 634 - DNA, 7 bp, Artificial Sequence
  Dyad patterns over-represented in STAR elements
  misc_feature (4)..(4): "N" stands for any nucleotide
cccncgc

SEQ ID NO: 635 - DNA, 22 bp, Artificial Sequence
  Dyad patterns over-represented in STAR elements
  misc_feature (4)..(19): "N" stands for any nucleotide
gccnnnnnnnnnnnnnnnngca

SEQ ID NO: 636 - DNA, 22 bp, Artificial Sequence
  Dyad patterns over-represented in STAR elements
  misc_feature (4)..(19): "N" stands for any nucleotide
cccnnnnnnnnnnnnnnnncca

SEQ ID NO: 637 - DNA, 19 bp, Artificial Sequence
  Dyad patterns over-represented in STAR elements
  misc_feature (4)..(16): "N" stands for any nucleotide
ccgnnnnnnnnnnnnncgc

SEQ ID NO: 638 - DNA, 23 bp, Artificial Sequence
  Dyad patterns over-represented in STAR elements
  misc_feature (4)..(20): "N" stands for any nucleotide
ccgnnnnnnnnnnnnnnnnncag

SEQ ID NO: 639 - DNA, 24 bp, Artificial Sequence
  Dyad patterns over-represented in STAR elements
  misc_feature (4)..(21): "N" stands for any nucleotide
cggnnnnnnnnnnnnnnnnnnggc

SEQ ID NO: 640 - DNA, 20 bp, Artificial Sequence
  Dyad patterns over-represented in STAR elements
  misc_feature (4)..(17): "N" stands for any nucleotide
ccgnnnnnnnnnnnnnnagg

SEQ ID NO: 641 - DNA, 11 bp, Artificial Sequence
  Dyad patterns over-represented in STAR elements
  misc_feature (4)..(8): "N" stands for any nucleotide
cccnnnnncgg

SEQ ID NO: 642 - DNA, 12 bp, Artificial Sequence
  Dyad patterns over-represented in STAR elements
  misc_feature (4)..(9): "N" stands for any nucleotide
cccnnnnnngga

SEQ ID NO: 643 - DNA, 8 bp, Artificial Sequence
  Dyad patterns over-represented in STAR elements
  misc_feature (4)..(5): "N" stands for any nucleotide
acgnnccc

SEQ ID NO: 644 - DNA, 15 bp, Artificial Sequence
  Dyad patterns over-represented in STAR elements
  misc_feature (4)..(12): "N" stands for any nucleotide
ccannnnnnnnnccg

SEQ ID NO: 645 - DNA, 25 bp, Artificial Sequence
  Dyad patterns over-represented in STAR elements
  misc_feature (4)..(22): "N" stands for any nucleotide
cccnnnnnnnnnnnnnnnnnnncca

SEQ ID NO: 646 - DNA, 6 bp, Artificial Sequence
  Dyad patterns over-represented in STAR elements
cagggg

SEQ ID NO: 647 - DNA, 7 bp, Artificial Sequence
  Dyad patterns over-represented in STAR elements
  misc_feature (4)..(4): "N" stands for any nucleotide
agcnccc

SEQ ID NO: 648 - DNA, 13 bp, Artificial Sequence
  Dyad patterns over-represented in STAR elements
  misc_feature (4)..(10): "N" stands for any nucleotide
gcgnnnnnnntcc

SEQ ID NO: 649 - DNA, 24 bp, Artificial Sequence
  Dyad patterns over-represented in STAR elements
  misc_feature (4)..(21): "N" stands for any nucleotide
acgnnnnnnnnnnnnnnnnnncca

SEQ ID NO: 650 - DNA, 20 bp, Artificial Sequence
  Dyad patterns over-represented in STAR elements
  misc_feature (4)..(17): "N" stands for any nucleotide
gctnnnnnnnnnnnnnnccc

SEQ ID NO: 651 - DNA, 20 bp, Artificial Sequence
  Dyad patterns over-represented in STAR elements
  misc_feature (4)..(17): "N" stands for any nucleotide
gcgnnnnnnnnnnnnnnccc

SEQ ID NO: 652 - DNA, 25 bp, Artificial Sequence
  Dyad patterns over-represented in STAR elements
  misc_feature (4)..(22): "N" stands for any nucleotide
gcgnnnnnnnnnnnnnnnnnnnagc

SEQ ID NO: 653 - DNA, 14 bp, Artificial Sequence
  Dyad patterns over-represented in STAR elements
  misc_feature (4)..(11): "N" stands for any nucleotide
ccgnnnnnnnncag

SEQ ID NO: 654 - DNA, 12 bp, Artificial Sequence
  Dyad patterns over-represented in STAR elements
  misc_feature (4)..(9): "N" stands for any nucleotide
gcgnnnnnngcc

SEQ ID NO: 655 - DNA, 16 bp, Artificial Sequence
  Dyad patterns over-represented in STAR elements
  misc_feature (4)..(13): "N" stands for any nucleotide
gcgnnnnnnnnnngca

SEQ ID NO: 656 - DNA, 13 bp, Artificial Sequence
  Dyad patterns over-represented in STAR elements
  misc_feature (4)..(10): "N" stands for any nucleotide
cctnnnnnnngcc

SEQ ID NO: 657 - DNA, 19 bp, Artificial Sequence
  Dyad patterns over-represented in STAR elements
  misc_feature (4)..(16): "N" stands for any nucleotide
gccnnnnnnnnnnnnngcc

SEQ ID NO: 658 - DNA, 20 bp, Artificial Sequence
  Dyad patterns over-represented in STAR elements
  misc_feature (4)..(17): "N" stands for any nucleotide
cccnnnnnnnnnnnnnngcc

SEQ ID NO: 659 - DNA, 21 bp, Artificial Sequence
  Dyad patterns over-represented in STAR elements
  misc_feature (4)..(18): "N" stands for any nucleotide
cccnnnnnnnnnnnnnnncgg

SEQ ID NO: 660 - DNA, 19 bp, Artificial Sequence
  Dyad patterns over-represented in STAR elements
  misc_feature (4)..(16): "N" stands for any nucleotide
ccannnnnnnnnnnnncgc

SEQ ID NO: 661 - DNA, 17 bp, Artificial Sequence
  Dyad patterns over-represented in STAR elements
  misc_feature (4)..(14): "N" stands for any nucleotide
agcnnnnnnnnnnnggg

SEQ ID NO: 662 - DNA, 6 bp, Artificial Sequence
  Dyad patterns over-represented in STAR elements
ggagcc

SEQ ID NO: 663 - DNA, 9 bp, Artificial Sequence
  Dyad patterns over-represented in STAR elements
  misc_feature (4)..(6): "N" stands for any nucleotide
gccnnntcc

SEQ ID NO: 664 - DNA, 11 bp, Artificial Sequence
  Dyad patterns over-represented in STAR elements
  misc_feature (4)..(8): "N" stands for any nucleotide
cctnnnnngcc

SEQ ID NO: 665 - DNA, 24 bp, Artificial Sequence
  Dyad patterns over-represented in STAR elements
  misc_feature (4)..(21): "N" stands for any nucleotide
cggnnnnnnnnnnnnnnnnnnccc

SEQ ID NO: 666 - DNA, 9 bp, Artificial Sequence
  Dyad patterns over-represented in STAR elements
  misc_feature (4)..(6): "N" stands for any nucleotide
cctnnnggc

SEQ ID NO: 667 - DNA, 6 bp, Artificial Sequence
  Dyad patterns over-represented in STAR elements
ccgctc

SEQ ID NO: 668 - DNA, 23 bp, Artificial Sequence
  Dyad patterns over-represented in STAR elements
  misc_feature (1)..(20): "N" stands for any nucleotide
agcnnnnnnnnnnnnnnnnngcg

SEQ ID NO: 669 - DNA, 20 bp, Artificial Sequence
  Dyad patterns over-represented in STAR elements
  misc_feature (4)..(17): "N" stands for any nucleotide
acgnnnnnnnnnnnnnnggg

SEQ ID NO: 670 - DNA, 18 bp, Artificial Sequence
  Dyad patterns over-represented in STAR elements
  misc_feature (4)..(15): "N" stands for any nucleotide
cgannnnnnnnnnnnggc

SEQ ID NO: 671 - DNA, 26 bp, Artificial Sequence
  Dyad patterns over-represented in STAR elements
  misc_feature (4)..(23): "N" stands for any nucleotide
cccnnnnnnnnnnnnnnnnnnnncgc

SEQ ID NO: 672 - DNA, 18 bp, Artificial Sequence
  Dyad patterns over-represented in STAR elements
  misc_feature (4)..(15): "N" stands for any nucleotide
acgnnnnnnnnnnnnctg

SEQ ID NO: 673 - DNA, 6 bp, Artificial Sequence
  Dyad patterns over-represented in STAR elements
ccgccc

SEQ ID NO: 674 - DNA, 16 bp, Artificial Sequence
  Dyad patterns over-represented in STAR elements
  misc_feature (4)..(13): "N" stands for any nucleotide
ccgnnnnnnnnnngga

SEQ ID NO: 675 - DNA, 9 bp, Artificial Sequence
  Dyad patterns over-represented in STAR elements
  misc_feature (4)..(6): "N" stands for any nucleotide
cccnnngcg

SEQ ID NO: 676 - DNA, 20 bp, Artificial Sequence
  Dyad patterns over-represented in STAR elements
  misc_feature (4)..(17): "N" stands for any nucleotide
gcgnnnnnnnnnnnnnncgc

SEQ ID NO: 677 - DNA, 14 bp, Artificial Sequence
  Dyad patterns over-represented in STAR elements
  misc_feature (4)..(11): "N" stands for any nucleotide
ccgnnnnnnnncgc

SEQ ID NO: 678 - DNA, 16 bp, Artificial Sequence
  Dyad patterns over-represented in STAR elements
  misc_feature (4)..(13): "N" stands for any nucleotide
cgcnnnnnnnnnnaca

SEQ ID NO: 679 - DNA, 25 bp, Artificial Sequence
  Dyad patterns over-represented in STAR elements
  misc_feature (4)..(22): "N" stands for any nucleotide
cccnnnnnnnnnnnnnnnnnnnccg

SEQ ID NO: 680 - DNA, 20 bp, Artificial Sequence
  Dyad patterns over-represented in STAR elements
  misc_feature (4)..(17): "N" stands for any nucleotide
cacnnnnnnnnnnnnnncgc

SEQ ID NO: 681 - DNA, 9 bp, Artificial Sequence
  Dyad patterns over-represented in STAR elements
  misc_feature (4)..(6): "N" stands for any nucleotide
gacnnnggc

SEQ ID NO: 682 - DNA, 13 bp, Artificial Sequence
  Dyad patterns over-represented in STAR elements
  misc_feature (4)..(10): "N" stands for any nucleotide
gaannnnnnncgc

SEQ ID NO: 683 - DNA, 22 bp, Artificial Sequence
  Dyad patterns over-represented in STAR elements
  misc_feature (4)..(19): "N" stands for any nucleotide
cgcnnnnnnnnnnnnnnnnggc

SEQ ID NO: 684 - DNA, 15 bp, Artificial Sequence
  Dyad patterns over-represented in STAR elements
  misc_feature (4)..(12): "N" stands for any nucleotide
ggcnnnnnnnnnccc

SEQ ID NO: 685 - DNA, 15 bp, Artificial Sequence
  Dyad patterns over-represented in STAR elements
  misc_feature (4)..(12): "N" stands for any nucleotide
cccnnnnnnnnngcc

SEQ ID NO: 686 - DNA, 6 bp, Artificial Sequence
  Dyad patterns over-represented in STAR elements
cgctgc

SEQ ID NO: 687 - DNA, 14 bp, Artificial Sequence
  Dyad patterns over-represented in STAR elements
  misc_feature (4)..(11): "N" stands for any nucleotide
cctnnnnnnnnggc

SEQ ID NO: 688 - DNA, 14 bp, Artificial Sequence
  Dyad patterns over-represented in STAR elements
  misc_feature (4)..(11): "N" stands for any nucleotide
ccannnnnnnnccc

SEQ ID NO: 689 - DNA, 8 bp, Artificial Sequence
  Dyad patterns over-represented in STAR elements
  misc_feature (4)..(5): "N" stands for any nucleotide
gacnnccc

SEQ ID NO: 690 - DNA, 7 bp, Artificial Sequence
  Dyad patterns over-represented in STAR elements
  misc_feature (4)..(4): "N" stands for any nucleotide
ggcnccc

SEQ ID NO: 691 - DNA, 6 bp, Artificial Sequence
  Dyad patterns over-represented in STAR elements
cgcagc

SEQ ID NO: 692 - DNA, 10 bp, Artificial Sequence
  Dyad patterns over-represented in STAR elements
  misc_feature (4)..(7): "N" stands for any nucleotide
aggnnnngcg

SEQ ID NO: 693 - DNA, 12 bp, Artificial Sequence
  Dyad patterns over-represented in STAR elements
  misc_feature (4)..(9): "N" stands for any nucleotide
cggnnnnnntcc

SEQ ID NO: 694 - DNA, 25 bp, Artificial Sequence
  Dyad patterns over-represented in STAR elements
  misc_feature (4)..(22): "N" stands for any nucleotide
acgnnnnnnnnnnnnnnnnnnnggc

SEQ ID NO: 695 - DNA, 14 bp, Artificial Sequence
  Dyad patterns over-represented in STAR elements
  misc_feature (4)..(11): "N" stands for any nucleotide
cccnnnnnnnnacg

SEQ ID NO: 696 - DNA, 24 bp, Artificial Sequence
  Dyad patterns over-represented in STAR elements
  misc_feature (4)..(21): "N" stands for any nucleotide
cccnnnnnnnnnnnnnnnnnngcc

SEQ ID NO: 697 - DNA, 8 bp, Artificial Sequence
  Dyad patterns over-represented in STAR elements
  misc_feature (4)..(5): "N" stands for any nucleotide
gccnncga

SEQ ID NO: 698 - DNA, 14 bp, Artificial Sequence
  Dyad patterns over-represented in STAR elements
  misc_feature (4)..(11): "N" stands for any nucleotide
cccnnnnnnnngcg

SEQ ID NO: 699 - DNA, 6 bp, Artificial Sequence
  Dyad patterns over-represented in STAR elements
cccctc

SEQ ID NO: 700 - DNA, 17 bp, Artificial Sequence
  Dyad patterns over-represented in STAR elements
  misc_feature (4)..(14): "N" stands for any nucleotide
gccnnnnnnnnnnncgc

SEQ ID NO: 701 - DNA, 15 bp, Artificial Sequence
  Dyad patterns over-represented in STAR elements
  misc_feature (4)..(12): "N" stands for any nucleotide
agcnnnnnnnnnccc

SEQ ID NO: 702 - DNA, 6 bp, Artificial Sequence
  Dyad patterns over-represented in STAR elements
gctgcc

SEQ ID NO: 703 - DNA, 9 bp, Artificial Sequence
  Dyad patterns over-represented in STAR elements
  misc_feature (4)..(6): "N" stands for any nucleotide
cgcnnnccc

SEQ ID NO: 704 - DNA, 8 bp, Artificial Sequence
  Dyad patterns over-represented in STAR elements
  misc_feature (4)..(5): "N" stands for any nucleotide
cccnnccc

SEQ ID NO: 705 - DNA, 15 bp, Artificial Sequence
  Dyad patterns over-represented in STAR elements
  misc_feature (4)..(12): "N" stands for any nucleotide
gccnnnnnnnnncgc

SEQ ID NO: 706 - DNA, 25 bp, Artificial Sequence
  Dyad patterns over-represented in STAR elements
  misc_feature (4)..(22): "N" stands for any nucleotide
gcannnnnnnnnnnnnnnnnnncgc

SEQ ID NO: 707 - DNA, 10 bp, Artificial Sequence
  Dyad patterns over-represented in STAR elements
  misc_feature (4)..(7): "N" stands for any nucleotide
cagnnnncgg

SEQ ID NO: 708 - DNA, 8 bp, Artificial Sequence
  Dyad patterns over-represented in STAR elements
  misc_feature (4)..(5): "N" stands for any nucleotide
cagnnggg

SEQ ID NO: 709 - DNA, 22 bp, Artificial Sequence
  Dyad patterns over-represented in STAR elements
  misc_feature (4)..(19): "N" stands for any nucleotide
gccnnnnnnnnnnnnnnnnccc

SEQ ID NO: 710 - DNA, 11 bp, Artificial Sequence
  Dyad patterns over-represented in STAR elements
  misc_feature (4)..(8): "N" stands for any nucleotide
gagnnnnnccc

SEQ ID NO: 711 - DNA, 22 bp, Artificial Sequence
  Dyad patterns over-represented in STAR elements
  misc_feature (4)..(19): "N" stands for any nucleotide
cctnnnnnnnnnnnnnnnntcg

SEQ ID NO: 712 - DNA, 9 bp, Artificial Sequence
  Dyad patterns over-represented in STAR elements
  misc_feature (4)..(6): "N" stands for any nucleotide
cccnnnggc

SEQ ID NO: 713 - DNA, 19 bp, Artificial Sequence
  Dyad patterns over-represented in STAR elements
  misc_feature (4)..(16): "N" stands for any nucleotide
gcgnnnnnnnnnnnnngga

SEQ ID NO: 714 - DNA, 23 bp, Artificial Sequence
  Dyad patterns over-represented in STAR elements
  misc_feature (4)..(20): "N" stands for any nucleotide
gccnnnnnnnnnnnnnnnnnggc

SEQ ID NO: 715 - DNA, 20 bp, Artificial Sequence
  Dyad patterns over-represented in STAR elements
  misc_feature (4)..(17): "N" stands for any nucleotide
cccnnnnnnnnnnnnnnggc

SEQ ID NO: 716 - DNA, 9 bp, Artificial Sequence
  Dyad patterns over-represented in STAR elements
  misc_feature (4)..(6): "N" stands for any nucleotide
aggnnnccg

SEQ ID NO: 717 - DNA, 6 bp, Artificial Sequence
  Dyad patterns over-represented in STAR elements
caccgc

SEQ ID NO: 718 - DNA, 24 bp, Artificial Sequence
  Dyad patterns over-represented in STAR elements
  misc_feature (4)..(21): "N" stands for any nucleotide
cggnnnnnnnnnnnnnnnnnncag

SEQ ID NO: 719 - DNA, 7 bp, Artificial Sequence
  Dyad patterns over-represented in STAR elements
  misc_feature (4)..(4): "N" stands for any nucleotide
agcngcc

SEQ ID NO: 720 - DNA, 24 bp, Artificial Sequence
  Dyad patterns over-represented in STAR elements
  misc_feature (4)..(21): "N" stands for any nucleotide
cgcnnnnnnnnnnnnnnnnnnggc

SEQ ID NO: 721 - DNA, 11 bp, Artificial Sequence
  Dyad patterns over-represented in STAR elements
  misc_feature (4)..(8): "N" stands for any nucleotide
cccnnnnnagg

SEQ ID NO: 722 - DNA, 6 bp, Artificial Sequence
  Dyad patterns over-represented in STAR elements
aacgcg

SEQ ID NO: 723 - DNA, 16 bp, Artificial Sequence
  Dyad patterns over-represented in STAR elements
  misc_feature (4)..(13): "N" stands for any nucleotide
cccnnnnnnnnnncca

SEQ ID NO: 724 - DNA, 19 bp, Artificial Sequence
  Dyad patterns over-represented in STAR elements
  misc_feature (4)..(16): "N" stands for any nucleotide
cgcnnnnnnnnnnnnngag

SEQ ID NO: 725 - DNA, 13 bp, Artificial Sequence
  Dyad patterns over-represented in STAR elements
  misc_feature (4)..(10): "N" stands for any nucleotide
cgcnnnnnnngcc

SEQ ID NO: 726 - DNA, 15 bp, Artificial Sequence
  Dyad patterns over-represented in STAR elements
  misc_feature (4)..(12): "N" stands for any nucleotide
cccnnnnnnnnnccg

SEQ ID NO: 727 - DNA, 22 bp, Artificial Sequence
  Dyad patterns over-represented in STAR elements
  misc_feature (4)..(19): "N" stands for any nucleotide
cgcnnnnnnnnnnnnnnnnccc

SEQ ID NO: 728 - DNA, 19 bp, Artificial Sequence
  Dyad patterns over-represented in STAR elements
  misc_feature (4)..(16): "N" stands for any nucleotide
gaannnnnnnnnnnnncgc

SEQ ID NO: 729 - DNA, 9 bp, Artificial Sequence
  Dyad patterns over-represented in STAR elements
  misc_feature (4)..(6): "N" stands for any nucleotide
ggcnnnccc

SEQ ID NO: 730 - DNA, 17 bp, Artificial Sequence
  Dyad patterns over-represented in STAR elements
  misc_feature (4)..(14): "N" stands for any nucleotide
tccnnnnnnnnnnncca

SEQ ID NO: 731 - DNA, 6 bp, Artificial Sequence
  Dyad patterns over-represented in STAR elements
cacccc

SEQ ID NO: 732 - DNA, 22 bp, Artificial Sequence
  Dyad patterns over-represented in STAR elements
  misc_feature (4)..(19): "N" stands for any nucleotide
cgcnnnnnnnnnnnnnnnnccg

SEQ ID NO: 733 - DNA, 21 bp, Artificial Sequence
  Dyad patterns over-represented in STAR elements
  misc_feature (4)..(18): "N" stands for any nucleotide
cggnnnnnnnnnnnnnnnagc

SEQ ID NO: 734 - DNA, 18 bp, Artificial Sequence
  Dyad patterns over-represented in STAR elements
  misc_feature (4)..(15): "N" stands for any nucleotide
cccnnnnnnnnnnnngcg

SEQ ID NO: 735 - DNA, 15 bp, Artificial Sequence
  Dyad patterns over-represented in STAR elements
  misc_feature (4)..(12): "N" stands for any nucleotide
cccnnnnnnnnngag

SEQ ID NO: 736 - DNA, 26 bp, Artificial Sequence
  Dyad patterns over-represented in STAR elements
  misc_feature (4)..(23): "N" stands for any nucleotide
ccgnnnnnnnnnnnnnnnnnnnntcc

SEQ ID NO: 737 - DNA, 6 bp, Artificial Sequence
  Dyad patterns over-represented in STAR elements
cgccgc

SEQ ID NO: 738 - DNA, 13 bp, Artificial Sequence
  Dyad patterns over-represented in STAR elements
  misc_feature (4)..(10): "N" stands for any nucleotide
atgnnnnnnncgg

SEQ ID NO: 739 - DNA, 26 bp, Artificial Sequence
  Dyad patterns over-represented in STAR elements
  misc_feature (4)..(23): "N" stands for any nucleotide
gggnnnnnnnnnnnnnnnnnnnngca

SEQ ID NO: 740 - DNA, 10 bp, Artificial Sequence
  Dyad patterns over-represented in STAR elements
  misc_feature (4)..(7): "N" stands for any nucleotide
cggnnnnggc

SEQ ID NO: 741 - DNA, 22 bp, Artificial Sequence
  Dyad patterns over-represented in STAR elements
  misc_feature (4)..(19): "N" stands for any nucleotide
cggnnnnnnnnnnnnnnnnagc

SEQ ID NO: 742 - DNA, 11 bp, Artificial Sequence
  Dyad patterns over-represented in STAR elements
  misc_feature (4)..(8): "N" stands for any nucleotide
cggnnnnnggc

SEQ ID NO: 743 - DNA, 6 bp, Artificial Sequence
  Dyad patterns over-represented in STAR elements
gcggga

SEQ ID NO: 744 - DNA, 26 bp, Artificial Sequence
  Dyad patterns over-represented in STAR elements
  misc_feature (4)..(23): "N" stands for any nucleotide
ggcnnnnnnnnnnnnnnnnnnnncac

SEQ ID NO: 745 - DNA, 15 bp, Artificial Sequence
  Dyad patterns over-represented in STAR elements
  misc_feature (4)..(12): "N" stands for any nucleotide
cccnnnnnnnnnccc

SEQ ID NO: 746 - DNA, 23 bp, Artificial Sequence
  Dyad patterns over-represented in STAR elements
  misc_feature (4)..(20): "N" stands for any nucleotide
accnnnnnnnnnnnnnnnnnggc

SEQ ID NO: 747 - DNA, 12 bp, Artificial Sequence
  Dyad patterns over-represented in STAR elements
  misc_feature (4)..(9): "N" stands for any nucleotide
cccnnnnnncga

SEQ ID NO: 748 - DNA, 16 bp, Artificial Sequence
  Dyad patterns over-represented in STAR elements
  misc_feature (4)..(13): "N" stands for any nucleotide
aagnnnnnnnnnncgg

SEQ ID NO: 749 - DNA, 23 bp, Artificial Sequence
  Dyad patterns over-represented in STAR elements
  misc_feature (4)..(20): "N" stands for any nucleotide
cgcnnnnnnnnnnnnnnnnncac

SEQ ID NO: 750 - DNA, 22 bp, Artificial Sequence
  Dyad patterns over-represented in STAR elements
  misc_feature (4)..(19): "N" stands for any nucleotide
cccnnnnnnnnnnnnnnnncgg

SEQ ID NO: 751 - DNA, 24 bp, Artificial Sequence
  Dyad patterns over-represented in STAR elements
  misc_feature (4)..(21): "N" stands for any nucleotide
gacnnnnnnnnnnnnnnnnnnggc

SEQ ID NO: 752 - DNA, 21 bp, Artificial Sequence
  Dyad patterns over-represented in STAR elements
  misc_feature (4)..(18): "N" stands for any nucleotide
gggnnnnnnnnnnnnnnngac

SEQ ID NO: 753 - DNA, 10 bp, Artificial Sequence
  Dyad patterns over-represented in STAR elements
  misc_feature (4)..(7): "N" stands for any nucleotide
gccnnnntcc

SEQ ID NO: 754 - DNA, 21 bp, Artificial Sequence
  Dyad patterns over-represented in STAR elements
  misc_feature (4)..(18): "N" stands for any nucleotide
ggcnnnnnnnnnnnnnnnccc

SEQ ID NO: 755 - DNA, 18 bp, Artificial Sequence
  Dyad patterns over-represented in STAR elements
  misc_feature (4)..(15): "N" stands for any nucleotide
cagnnnnnnnnnnnncgc

SEQ ID NO: 756 - DNA, 9 bp, Artificial Sequence
  Dyad patterns over-represented in STAR elements
  misc_feature (4)..(6): "N" stands for any nucleotide
ccannngcg

SEQ ID NO: 757 - DNA, 22 bp, Artificial Sequence
  Dyad patterns over-represented in STAR elements
  misc_feature (4)..(19): "N" stands for any nucleotide
ccgnnnnnnnnnnnnnnnngag

SEQ ID NO: 758 - DNA, 8 bp, Artificial Sequence
  Dyad patterns over-represented in STAR elements
  misc_feature (4)..(5): "N" stands for any nucleotide
agcnncgc

SEQ ID NO: 759 - DNA, 10 bp, Artificial Sequence
  Dyad patterns over-represented in STAR elements
  misc_feature (4)..(7): "N" stands for any nucleotide
gagnnnnccc

SEQ ID NO: 760 - DNA, 9 bp, Artificial Sequence
  Dyad patterns over-represented in STAR elements
  misc_feature (4)..(6): "N" stands for any nucleotide
aggnnncgc

SEQ ID NO: 761 - DNA, 19 bp, Artificial Sequence
  Dyad patterns over-represented in STAR elements
  misc_feature (4)..(16): "N" stands for any nucleotide
cacnnnnnnnnnnnnnagg

SEQ ID NO: 762 - DNA, 10 bp, Artificial Sequence
  Dyad patterns over-represented in STAR elements
  misc_feature (4)..(7): "N" stands for any nucleotide
cccnnnncag

SEQ ID NO: 763 - DNA, 8 bp, Artificial Sequence
  Dyad patterns over-represented in STAR elements
  misc_feature (4)..(5): "N" stands for any nucleotide
cccnngaa

SEQ ID NO: 764 - DNA, 25 bp, Artificial Sequence
  Dyad patterns over-represented in STAR elements
  misc_feature (4)..(22): "N" stands for any nucleotide
cgcnnnnnnnnnnnnnnnnnnngag

SEQ ID NO: 765 - DNA, 24 bp, Artificial Sequence
  Dyad patterns over-represented in STAR elements
  misc_feature (4)..(21): "N" stands for any nucleotide
acgnnnnnnnnnnnnnnnnnnggg

SEQ ID NO: 766 - DNA, 10 bp, Artificial Sequence
  Dyad patterns over-represented in STAR elements
  misc_feature (4)..(7): "N" stands for any nucleotide
cccnnnnggc

SEQ ID NO: 767 - DNA, 15 bp, Artificial Sequence
  Dyad patterns over-represented in STAR elements
  misc_feature (4)..(12): "N" stands for any nucleotide
cggnnnnnnnnngag

SEQ ID NO: 768 - DNA, 9 bp, Artificial Sequence
  Dyad patterns over-represented in STAR elements
  misc_feature (4)..(6): "N" stands for any nucleotide
cccnnnggg

SEQ ID NO: 769 - DNA, 10 bp, Artificial Sequence
  Dyad patterns over-represented in STAR elements
  misc_feature (4)..(7): "N" stands for any nucleotide
gagnnnnggc

SEQ ID NO: 770 - DNA, 11 bp, Artificial Sequence
  Dyad patterns over-represented in STAR elements
  misc_feature (4)..(8): "N" stands for any nucleotide
cgcnnnnngag

SEQ ID NO: 771 - DNA, 26 bp, Artificial Sequence
  Dyad patterns over-represented in STAR elements
  misc_feature (4)..(23): "N" stands for any nucleotide
ccgnnnnnnnnnnnnnnnnnnnnagg

SEQ ID NO: 772 - DNA, 21 bp, Artificial Sequence
  Dyad patterns over-represented in STAR elements
  misc_feature (4)..(18): "N" stands for any nucleotide
cccnnnnnnnnnnnnnnnccc

SEQ ID NO: 773 - DNA, 23 bp, Artificial Sequence
  Dyad patterns over-represented in STAR elements
  misc_feature (4)..(20): "N" stands for any nucleotide
aggnnnnnnnnnnnnnnnnnccg

SEQ ID NO: 774 - DNA, 12 bp, Artificial Sequence
  Dyad patterns over-represented in STAR elements
  misc_feature (4)..(9): "N" stands for any nucleotide
aggnnnnnnggg

SEQ ID NO: 775 - DNA, 26 bp, Artificial Sequence
  Dyad patterns over-represented in STAR elements
  misc_feature (4)..(23): "N" stands for any nucleotide
ggcnnnnnnnnnnnnnnnnnnnnccc

SEQ ID NO: 776 - DNA, 23 bp, Artificial Sequence
  Dyad patterns over-represented in STAR elements
  misc_feature (4)..(20): "N" stands for any nucleotide
gcannnnnnnnnnnnnnnnncgc

SEQ ID NO: 777 - DNA, 17 bp, Artificial Sequence
  Dyad patterns over-represented in STAR elements
  misc_feature (4)..(14): "N" stands for any nucleotide
cgannnnnnnnnnnacg

SEQ ID NO: 778 - DNA, 8 bp, Artificial Sequence
  Dyad patterns over-represented in STAR elements
  misc_feature (4)..(5): "N" stands for any nucleotide
cgcnngga

SEQ ID NO: 779 - DNA, 11 bp, Artificial Sequence
  Dyad patterns over-represented in STAR elements
  misc_feature (4)..(8): "N" stands for any nucleotide
ctgnnnnnccc

SEQ ID NO: 780 - DNA, 26 bp, Artificial Sequence
  Dyad patterns over-represented in STAR elements
  misc_feature (4)..(23): "N" stands for any nucleotide
tccnnnnnnnnnnnnnnnnnnnncca

SEQ ID NO: 781 - DNA, 8 bp, Artificial Sequence
  Dyad patterns over-represented in STAR elements
  misc_feature (4)..(5): "N" stands for any nucleotide
ccannggg

SEQ ID NO: 782 - DNA, 21 bp, Artificial Sequence
  Dyad patterns over-represented in STAR elements
  misc_feature (4)..(18): "N" stands for any nucleotide
ccgnnnnnnnnnnnnnnngcg

SEQ ID NO: 783 - DNA, 11 bp, Artificial Sequence
  Dyad patterns over-represented in STAR elements
  misc_feature (4)..(8): "N" stands for any nucleotide
ccannnnnggg

SEQ ID NO: 784 - DNA, 7 bp, Artificial Sequence
  Dyad patterns over-represented in STAR elements
  misc_feature (4)..(4): "N" stands for any nucleotide
cggntgc

SEQ ID NO: 785 - DNA, 20 bp, Artificial Sequence
  Dyad patterns over-represented in STAR elements
  misc_feature (4)..(17): "N" stands for any nucleotide
cccnnnnnnnnnnnnnngcg

SEQ ID NO: 786 - DNA, 6 bp, Artificial Sequence
  Dyad patterns over-represented in STAR elements
cagccg

SEQ ID NO: 787 - DNA, 15 bp, Artificial Sequence
  Dyad patterns over-represented in STAR elements
  misc_feature (4)..(12): "N" stands for any nucleotide
gccnnnnnnnnntcc

SEQ ID NO: 788 - DNA, 26 bp, Artificial Sequence
  Dyad patterns over-represented in STAR elements
  misc_feature (4)..(23): "N" stands for any nucleotide
aggnnnnnnnnnnnnnnnnnnnncgc

SEQ ID NO: 789 - DNA, 12 bp, Artificial Sequence
  Dyad patterns over-represented in STAR elements
  misc_feature (4)..(9): "N" stands for any nucleotide
cccnnnnnngac

SEQ ID NO: 790 - DNA, 17 bp, Artificial Sequence
  Dyad patterns over-represented in STAR elements
  misc_feature (4)..(14): "N" stands for any nucleotide
cggnnnnnnnnnnncca

SEQ ID NO: 791 - DNA, 20 bp, Artificial Sequence
  Dyad patterns over-represented in STAR elements
  misc_feature (4)..(17): "N" stands for any nucleotide
gggnnnnnnnnnnnnnncac

SEQ ID NO: 792 - DNA, 21 bp, Artificial Sequence
  Dyad patterns over-represented in STAR elements
  misc_feature (4)..(18): "N" stands for any nucleotide
gcannnnnnnnnnnnnnncgc

SEQ ID NO: 793 - DNA, 8 bp, Artificial Sequence
  Dyad patterns over-represented in STAR elements
  misc_feature (4)..(5): "N" stands for any nucleotide
cgcnnaca

SEQ ID NO: 794 - DNA, 15 bp, Artificial Sequence
  Dyad patterns over-represented in STAR elements
  misc_feature (4)..(12): "N" stands for any nucleotide
accnnnnnnnnnccc

SEQ ID NO: 795 - DNA, 15 bp, Artificial Sequence
  Dyad patterns over-represented in STAR elements
  misc_feature (4)..(12): "N" stands for any nucleotide
gcgnnnnnnnnncgc

SEQ ID NO: 796 - DNA, 21 bp, Artificial Sequence
  Dyad patterns over-represented in STAR elements
  misc_feature (4)..(18): "N" stands for any nucleotide
cagnnnnnnnnnnnnnnngcg

SEQ ID NO: 797 - DNA, 24 bp, Artificial Sequence
  Dyad patterns over-represented in STAR elements
  misc_feature (4)..(21): "N" stands for any nucleotide
cccnnnnnnnnnnnnnnnnnngtc

SEQ ID NO: 798 - DNA, 9 bp, Artificial Sequence
  Dyad patterns over-represented in STAR elements
  misc_feature (4)..(6): "N" stands for any nucleotide
gcgnnnccc

SEQ ID NO: 799 - DNA, 17 bp, Artificial Sequence
  Dyad patterns over-represented in STAR elements
  misc_feature (4)..(14): "N" stands for any nucleotide
cggnnnnnnnnnnngcc

SEQ ID NO: 800 - DNA, 7 bp, Artificial Sequence
  Dyad patterns over-represented in STAR elements
  misc_feature (4)..(4): "N" stands for any nucleotide
cccncgg

SEQ ID NO: 801 - DNA, 10 bp, Artificial Sequence
  Dyad patterns over-represented in STAR elements
  misc_feature (4)..(7): "N" stands for any nucleotide
gccnnnncca

SEQ ID NO: 802 - DNA, 10 bp, Artificial Sequence
  Dyad patterns over-represented in STAR elements
  misc_feature (4)..(7): "N" stands for any nucleotide
cccnnnnccg

SEQ ID NO: 803 - DNA, 8 bp, Artificial Sequence
  Dyad patterns over-represented in STAR elements
  misc_feature (4)..(5): "N" stands for any nucleotide
cgtnngca

SEQ ID NO: 804 - DNA, 13 bp, Artificial Sequence
  Dyad patterns over-represented in STAR elements
  misc_feature (4)..(10): "N" stands for any nucleotide
agcnnnnnnntcg

SEQ ID NO: 805 - DNA, 21 bp, Artificial Sequence
  Dyad patterns over-represented in STAR elements
  misc_feature (4)..(18): "N" stands for any nucleotide
ccgnnnnnnnnnnnnnnngaa

SEQ ID NO: 806 - DNA, 11 bp, Artificial Sequence
  Dyad patterns over-represented in STAR elements
  misc_feature (4)..(8): "N" stands for any nucleotide
accnnnnnccc

SEQ ID NO: 807 - DNA, 20 bp, Artificial Sequence
  Dyad patterns over-represented in STAR elements
  misc_feature (4)..(17): "N" stands for any nucleotide
cgcnnnnnnnnnnnnnngag

SEQ ID NO: 808 - DNA, 13 bp, Artificial Sequence
  Dyad patterns over-represented in STAR elements
  misc_feature (4)..(10): "N" stands for any nucleotide
cccnnnnnnncgc

SEQ ID NO: 809 - DNA, 18 bp, Artificial Sequence
  Dyad patterns over-represented in STAR elements
  misc_feature (4)..(15): "N" stands for any nucleotide
gagnnnnnnnnnnnncgc

SEQ ID NO: 810 - DNA, 23 bp, Artificial Sequence
  Dyad patterns over-represented in STAR elements
  misc_feature (4)..(20): "N" stands for any nucleotide
ggcnnnnnnnnnnnnnnnnnccc

SEQ ID NO: 811 - DNA, 17 bp, Artificial Sequence
  Dyad patterns over-represented in STAR elements
  misc_feature (4)..(14): "N" stands for any nucleotide
acgnnnnnnnnnnnctc

SEQ ID NO: 812 - DNA, 15 bp, Artificial Sequence
  Dyad patterns over-represented in STAR elements
  misc_feature (4)..(12): "N" stands for any nucleotide
acannnnnnnnncgg

SEQ ID NO: 813 - DNA, 13 bp, Artificial Sequence
  Dyad patterns over-represented in STAR elements
  misc_feature (4)..(10): "N" stands for any nucleotide
ctgnnnnnnnccc

SEQ ID NO: 814 - DNA, 8 bp, Artificial Sequence
  Dyad patterns over-represented in STAR elements
  misc_feature (4)..(5): "N" stands for any nucleotide
cccnngcc

SEQ ID NO: 815 - DNA, 8 bp, Artificial Sequence
  Dyad patterns over-represented in STAR elements
  misc_feature (4)..(5): "N" stands for any nucleotide
cggnngca

SEQ ID NO: 816 - DNA, 6 bp, Artificial Sequence
  Dyad patterns over-represented in STAR elements
ccctgc

SEQ ID NO: 817 - DNA, 13 bp, Artificial Sequence
  Dyad patterns over-represented in STAR elements
  misc_feature (4)..(10): "N" stands for any nucleotide
cgcnnnnnnnacc

SEQ ID NO: 818 - DNA, 8 bp, Artificial Sequence
  Dyad patterns over-represented in STAR elements
  misc_feature (4)..(5): "N" stands for any nucleotide
gcanngcc

SEQ ID NO: 819 - DNA, 14 bp, Artificial Sequence
  Dyad patterns over-represented in STAR elements
  misc_feature (4)..(11): "N" stands for any nucleotide
gcgnnnnnnnncca

SEQ ID NO: 820 - DNA, 6 bp, Artificial Sequence
  Dyad patterns over-represented in STAR elements
agccgc

SEQ ID NO: 821 - DNA, 8 bp, Artificial Sequence
  Dyad patterns over-represented in STAR elements
  misc_feature (4)..(5): "N" stands for any nucleotide
gcgnngca

SEQ ID NO: 822 - DNA, 8 bp, Artificial Sequence
  Dyad patterns over-represented in STAR elements
  misc_feature (4)..(5): "N" stands for any nucleotide
ccgnngtc

SEQ ID NO: 823 - DNA, 9 bp, Artificial Sequence
  Dyad patterns over-represented in STAR elements
  misc_feature (4)..(6): "N" stands for any nucleotide
ccgnnnaca

SEQ ID NO: 824 - DNA, 19 bp, Artificial Sequence
  Dyad patterns over-represented in STAR elements
  misc_feature (4)..(16): "N" stands for any nucleotide
acgnnnnnnnnnnnnntgg

SEQ ID NO: 825 - DNA, 14 bp, Artificial Sequence
  Dyad patterns over-represented in STAR elements
  misc_feature (4)..(11): "N" stands for any nucleotide
ccannnnnnnncgc

SEQ ID NO: 826 - DNA, 15 bp, Artificial Sequence
  Dyad patterns over-represented in STAR elements
  misc_feature (4)..(12): "N" stands for any nucleotide
ccgnnnnnnnnnggc

SEQ ID NO: 827 - DNA, 11 bp, Artificial Sequence
  Dyad patterns over-represented in STAR elements
  misc_feature (4)..(8): "N" stands for any nucleotide
ccannnnnccg

SEQ ID NO: 828 - DNA, 9 bp, Artificial Sequence
  Dyad patterns over-represented in STAR elements
  misc_feature (4)..(6): "N" stands for any nucleotide
aggnnnggg

SEQ ID NO: 829 - DNA, 8 bp, Artificial Sequence
  Dyad patterns over-represented in STAR elements
  misc_feature (4)..(5): "N" stands for any nucleotide
cagnnggc

SEQ ID NO: 830 - DNA, 14 bp, Artificial Sequence
  Dyad patterns over-represented in STAR elements
  misc_feature (4)..(11): "N" stands for any nucleotide
cccnnnnnnnncag

SEQ ID NO: 831 - DNA, 11 bp, Artificial Sequence
  Dyad patterns over-represented in STAR elements
  misc_feature (4)..(8): "N" stands for any nucleotide
agcnnnnncag

SEQ ID NO: 832 - DNA, 22 bp, Artificial Sequence
  Dyad patterns over-represented in STAR elements
  misc_feature (4)..(19): "N" stands for any nucleotide
cggnnnnnnnnnnnnnnnngcc

SEQ ID NO: 833 - DNA, 21 bp, Artificial Sequence
  Dyad patterns over-represented in STAR elements
  misc_feature (4)..(18): "N" stands for any nucleotide
gcgnnnnnnnnnnnnnnnccc

SEQ ID NO: 834 - DNA, 17 bp, Artificial Sequence
  Dyad patterns over-represented in STAR elements
  misc_feature (4)..(14): "N" stands for any nucleotide
cccnnnnnnnnnnngcc

SEQ ID NO: 835 - DNA, 8 bp, Artificial Sequence
  Dyad patterns over-represented in STAR elements
  misc_feature (4)..(5): "N" stands for any nucleotide
cgannacg

SEQ ID NO: 836 - DNA, 10 bp, Artificial Sequence
  Dyad patterns over-represented in STAR elements
  misc_feature (4)..(7): "N" stands for any nucleotide
cggnnnngcc

SEQ ID NO: 837 - DNA, 12 bp, Artificial Sequence
  Dyad patterns over-represented in STAR elements
  misc_feature (4)..(9): "N" stands for any nucleotide
cacnnnnnncgc

SEQ ID NO: 838 - DNA, 11 bp, Artificial Sequence
  Dyad patterns over-represented in STAR elements
  misc_feature (4)..(8): "N" stands for any nucleotide
cggnnnnnacg

SEQ ID NO: 839 - DNA, 10 bp, Artificial Sequence
  Dyad patterns over-represented in STAR elements
  misc_feature (4)..(7): "N" stands for any nucleotide
ctgnnnngcc

SEQ ID NO: 840 - DNA, 24 bp, Artificial Sequence
  Dyad patterns over-represented in STAR elements
  misc_feature (4)..(21): "N" stands for any nucleotide
gggnnnnnnnnnnnnnnnnnncga

SEQ ID NO: 841 - DNA, 14 bp, Artificial Sequence
  Dyad patterns over-represented in STAR elements
  misc_feature (4)..(11): "N" stands for any nucleotide
cctnnnnnnnncgc

SEQ ID NO: 842 - DNA, 10 bp, Artificial Sequence
  Dyad patterns over-represented in STAR elements
  misc_feature (4)..(7): "N" stands for any nucleotide
gccnnnnccc

SEQ ID NO: 843 - DNA, 16 bp, Artificial Sequence
  Dyad patterns over-represented in STAR elements
  misc_feature (4)..(13): "N" stands for any nucleotide
cggnnnnnnnnnngcc

SEQ ID NO: 844 - DNA, 11 bp, Artificial Sequence
  Dyad patterns over-represented in STAR elements
  misc_feature (4)..(8): "N" stands for any nucleotide
gccnnnnngga

SEQ ID NO: 845 - DNA, 13 bp, Artificial Sequence
  Dyad patterns over-represented in STAR elements
  misc_feature (4)..(10): "N" stands for any nucleotide
accnnnnnnngcg

SEQ ID NO: 846 - DNA, 14 bp, Artificial Sequence
  Dyad patterns over-represented in STAR elements
  misc_feature (4)..(11): "N" stands for any nucleotide
cccnnnnnnnncgc

SEQ ID NO: 847 - DNA, 11 bp, Artificial Sequence
  Dyad patterns over-represented in STAR elements
  misc_feature (4)..(8): "N" stands for any nucleotide
cagnnnnnccc

SEQ ID NO: 848 - DNA, 20 bp, Artificial Sequence
  Dyad patterns over-represented in STAR elements
  misc_feature (4)..(17): "N" stands for any nucleotide
cacnnnnnnnnnnnnnngga

SEQ ID NO: 849 - DNA, 7 bp, Artificial Sequence
  Dyad patterns over-represented in STAR elements
  misc_feature (4)..(4): "N" stands for any nucleotide
cccngcc

SEQ ID NO: 850 - DNA, 11 bp, Artificial Sequence
  Dyad patterns over-represented in STAR elements
  misc_feature (4)..(8): "N" stands for any nucleotide
cccnnnnnagc

SEQ ID NO: 851 - DNA, 11 bp, Artificial Sequence
  Dyad patterns over-represented in STAR elements
  misc_feature (4)..(8): "N" stands for any nucleotide
ggcnnnnngga

SEQ ID NO: 852 - DNA, 23 bp, Artificial Sequence
  Dyad patterns over-represented in STAR elements
  misc_feature (4)..(20): "N" stands for any nucleotide
cgannnnnnnnnnnnnnnnngag

SEQ ID NO: 853 - DNA, 13 bp, Artificial Sequence
  Dyad patterns over-represented in STAR elements
  misc_feature (4)..(10): "N" stands for any nucleotide
cgcnnnnnnnaca

SEQ ID NO: 854 - DNA, 19 bp, Artificial Sequence
  Dyad patterns over-represented in STAR elements
  misc_feature (4)..(16): "N" stands for any nucleotide
ccannnnnnnnnnnnnccc

SEQ ID NO: 855 - DNA, 26 bp, Artificial Sequence
  Dyad patterns over-represented in STAR elements
  misc_feature (4)..(23): "N" stands for any nucleotide
cggnnnnnnnnnnnnnnnnnnnnggc

SEQ ID NO: 856 - DNA, 23 bp, Artificial Sequence
  Dyad patterns over-represented in STAR elements
  misc_feature (4)..(20): "N" stands for any nucleotide
cccnnnnnnnnnnnnnnnnngcc

SEQ ID NO: 857 - DNA, 16 bp, Artificial Sequence
  Dyad patterns over-represented in STAR elements
  misc_feature (4)..(13): "N" stands for any nucleotide
cctnnnnnnnnnnccg

SEQ ID NO: 858 - DNA, 14 bp, Artificial Sequence
  Dyad patterns over-represented in STAR elements
  misc_feature (4)..(11): "N" stands for any nucleotide
cccnnnnnnnnccg

SEQ ID NO: 859 - DNA, 9 bp, Artificial Sequence
  Dyad patterns over-represented in STAR elements
  misc_feature (4)..(6): "N" stands for any nucleotide
cgcnnngag

SEQ ID NO: 860 - DNA, 13 bp, Artificial Sequence
  Dyad patterns over-represented in STAR elements
  misc_feature (4)..(10): "N" stands for any nucleotide
cgcnnnnnnnaag

SEQ ID NO: 861 - DNA, 17 bp, Artificial Sequence
  Dyad patterns over-represented in STAR elements
  misc_feature (4)..(14): "N" stands for any nucleotide
cggnnnnnnnnnnngga

SEQ ID NO: 862 - DNA, 21 bp, Artificial Sequence
  Dyad patterns over-represented in STAR elements
  misc_feature (4)..(18): "N" stands for any nucleotide
ccgnnnnnnnnnnnnnnnccg

SEQ ID NO: 863 - DNA, 9 bp, Artificial Sequence
  Dyad patterns over-represented in STAR elements
  misc_feature (4)..(6): "N" stands for any nucleotide
cccnnngca

SEQ ID NO: 864 - DNA, 8 bp, Artificial Sequence
  Dyad patterns over-represented in STAR elements
  misc_feature (4)..(5): "N" stands for any nucleotide
cggnncag

SEQ ID NO: 865 - DNA, 8 bp, Artificial Sequence
  Dyad patterns over-represented in STAR elements
  misc_feature (4)..(5): "N" stands for any nucleotide
aggnnccg

SEQ ID NO: 866 - DNA, 10 bp, Artificial Sequence
  Dyad patterns over-represented in STAR elements
  misc_feature (4)..(7): "N" stands for any nucleotide
cccnnnncac

SEQ ID NO: 867 - DNA, 25 bp, Artificial Sequence
  Dyad patterns over-represented in STAR elements
  misc_feature (4)..(22): "N" stands for any nucleotide
ggannnnnnnnnnnnnnnnnnnccc

SEQ ID NO: 868 - DNA, 14 bp, Artificial Sequence
  Dyad patterns over-represented in STAR elements
  misc_feature (4)..(11): "N" stands for any nucleotide
cccnnnnnnnncac

SEQ ID NO: 869 - DNA, 12 bp, Artificial Sequence
  Dyad patterns over-represented in STAR elements
  misc_feature (4)..(9): "N" stands for any nucleotide
accnnnnnnccg

SEQ ID NO: 870 - DNA, 12 bp, Artificial Sequence
  Dyad patterns over-represented in STAR elements
  misc_feature (4)..(9): "N" stands for any nucleotide
cccnnnnnnggc

SEQ ID NO: 871 - DNA, 12 bp, Artificial Sequence
  Dyad patterns over-represented in STAR elements
  misc_feature (4)..(9): "N" stands for any nucleotide
cccnnnnnnccg

SEQ ID NO: 872 - DNA, 20 bp, Artificial Sequence
  Dyad patterns over-represented in STAR elements
  misc_feature (4)..(17): "N" stands for any nucleotide
cgcnnnnnnnnnnnnnngcc

SEQ ID NO: 873 - DNA, 11 bp, Artificial Sequence
  Dyad patterns over-represented in STAR elements
  misc_feature (4)..(8): "N" stands for any nucleotide
ccgnnnnntcc

SEQ ID NO: 874 - DNA, 12 bp, Artificial Sequence
  Dyad patterns over-represented in STAR elements
  misc_feature (4)..(9): "N" stands for any nucleotide
gccnnnnnngcc

SEQ ID NO: 875 - DNA, 13 bp, Artificial Sequence
  Dyad patterns over-represented in STAR elements
  misc_feature (4)..(10): "N" stands for any nucleotide
cggnnnnnnngga

SEQ ID NO: 876 - DNA, 12 bp, Artificial Sequence
  Dyad patterns over-represented in STAR elements
  misc_feature (4)..(9): "N" stands for any nucleotide
gggnnnnnngga

SEQ ID NO: 877 - DNA, 18 bp, Artificial Sequence
  Dyad patterns over-represented in STAR elements
  misc_feature (4)..(15): "N" stands for any nucleotide
gccnnnnnnnnnnnntcc

SEQ ID NO: 878 - DNA, 22 bp, Artificial Sequence
  Dyad patterns over-represented in STAR elements
  misc_feature (4)..(19): "N" stands for any nucleotide
agtnnnnnnnnnnnnnnnnccg

SEQ ID NO: 879 - DNA, 25 bp, Artificial Sequence
  Dyad patterns over-represented in STAR elements
  misc_feature (4)..(22): "N" stands for any nucleotide
ggcnnnnnnnnnnnnnnnnnnngcc

SEQ ID NO: 880 - DNA, 9 bp, Artificial Sequence
  Dyad patterns over-represented in STAR elements
  misc_feature (4)..(6): "N" stands for any nucleotide
ccgnnnccg

SEQ ID NO: 881 - DNA, 14 bp, Artificial Sequence
  Dyad patterns over-represented in STAR elements
  misc_feature (4)..(11): "N" stands for any nucleotide
cccnnnnnnnnacc

SEQ ID NO: 882 - DNA, 21 bp, Artificial Sequence
  Dyad patterns over-represented in STAR elements
  misc_feature (4)..(18): "N" stands for any nucleotide
cagnnnnnnnnnnnnnnngcc

SEQ ID NO: 883 - DNA, 23 bp, Artificial Sequence
  Dyad patterns over-represented in STAR elements
  misc_feature (4)..(20): "N" stands for any nucleotide
cccnnnnnnnnnnnnnnnnncgg

SEQ ID NO: 884 - DNA, 7 bp, Artificial Sequence
  Dyad patterns over-represented in STAR elements
  misc_feature (4)..(4): "N" stands for any nucleotide
gcgncca

SEQ ID NO: 885 - DNA, 20 bp, Artificial Sequence
  Dyad patterns over-represented in STAR elements
  misc_feature (4)..(17): "N" stands for any nucleotide
cccnnnnnnnnnnnnnncag

SEQ ID NO: 886 - DNA, 14 bp, Artificial Sequence
  Dyad patterns over-represented in STAR elements
  misc_feature (4)..(11): "N" stands for any nucleotide
cccnnnnnnnnccc

SEQ ID NO: 887 - DNA, 18 bp, Artificial Sequence
  Dyad patterns over-represented in STAR elements
  misc_feature (4)..(15): "N" stands for any nucleotide
acannnnnnnnnnnngcg

SEQ ID NO: 888 - DNA, 10 bp, Artificial Sequence
  Dyad patterns over-represented in STAR elements
  misc_feature (4)..(7): "N" stands for any nucleotide
aggnnnnccg

SEQ ID NO: 889 - DNA, 19 bp, Artificial Sequence
  Dyad patterns over-represented in STAR elements
  misc_feature (4)..(16): "N" stands for any nucleotide
cgcnnnnnnnnnnnnngcc

SEQ ID NO: 890 - DNA, 8 bp, Artificial Sequence
  Dyad patterns over-represented in STAR elements
  misc_feature (4)..(5): "N" stands for any nucleotide
gagnncgc

SEQ ID NO: 891 - DNA, 15 bp, Artificial Sequence
  Dyad patterns over-represented in STAR elements
  misc_feature (4)..(12): "N" stands for any nucleotide
cccnnnnnnnnngcg

SEQ ID NO: 892 - DNA, 23 bp, Artificial Sequence
  Dyad patterns over-represented in STAR elements
  misc_feature (4)..(20): "N" stands for any nucleotide
cgcnnnnnnnnnnnnnnnnnaca

SEQ ID NO: 893 - DNA, 23 bp, Artificial Sequence
  Dyad patterns over-represented in STAR elements
  misc_feature (4)..(20): "N" stands for any nucleotide
gcgnnnnnnnnnnnnnnnnncca

SEQ ID NO: 894 - DNA, 24 bp, Artificial Sequence
  Dyad patterns over-represented in STAR elements
  misc_feature (4)..(21): "N" stands for any nucleotide
aagnnnnnnnnnnnnnnnnnnccg

SEQ ID NO: 895 - DNA, 7 bp, Artificial Sequence
  Dyad patterns over-represented in STAR elements
  misc_feature (4)..(4): "N" stands for any nucleotide
cgcngga

SEQ ID NO: 896 - DNA, 7 bp, Artificial Sequence
  Dyad patterns over-represented in STAR elements
  misc_feature (4)..(4): "N" stands for any nucleotide
ccanccc

SEQ ID NO: 897 - DNA, 24 bp, Artificial Sequence
  Dyad patterns over-represented in STAR elements
  misc_feature (4)..(21): "N" stands for any nucleotide
cgtnnnnnnnnnnnnnnnnnntgc

SEQ ID NO: 898 - DNA, 20 bp, Artificial Sequence
  Dyad patterns over-represented in STAR elements
  misc_feature (4)..(17): "N" stands for any nucleotide
tccnnnnnnnnnnnnnncga

SEQ ID NO: 899 - DNA, 11 bp, Artificial Sequence
  Dyad patterns over-represented in STAR elements
  misc_feature (4)..(8): "N" stands for any nucleotide
cacnnnnnggg

SEQ ID NO: 900 - DNA, 18 bp, Artificial Sequence
  Dyad patterns over-represented in STAR elements
  misc_feature (4)..(15): "N" stands for any nucleotide
ccgnnnnnnnnnnnngca

SEQ ID NO: 901 - DNA, 12 bp, Artificial Sequence
  Dyad patterns over-represented in STAR elements
  misc_feature (4)..(9): "N" stands for any nucleotide
ctgnnnnnnccc

SEQ ID NO: 902 - DNA, 14 bp, Artificial Sequence
  Dyad patterns over-represented in STAR elements
  misc_feature (4)..(11): "N" stands for any nucleotide
cggnnnnnnnnggc

SEQ ID NO: 903 - DNA, 17 bp, Artificial Sequence
  Dyad patterns over-represented in STAR elements
  misc_feature (4)..(14): "N" stands for any nucleotide
ccannnnnnnnnnnggg

SEQ ID NO: 904 - DNA, 25 bp, Artificial Sequence
  Dyad patterns over-represented in STAR elements
  misc_feature (4)..(22): "N" stands for any nucleotide
acgnnnnnnnnnnnnnnnnnnncaa

SEQ ID NO: 905 - DNA, 26 bp, Artificial Sequence
  Dyad patterns over-represented in STAR elements
  misc_feature (4)..(23): "N" stands for any nucleotide
gggnnnnnnnnnnnnnnnnnnnnccc

SEQ ID NO: 906 - DNA, 10 bp, Artificial Sequence
  Dyad patterns over-represented in STAR elements
  misc_feature (4)..(7): "N" stands for any nucleotide
cgcnnnncag

SEQ ID NO: 907 - DNA, 23 bp, Artificial Sequence
  Dyad patterns over-represented in STAR elements
  misc_feature (4)..(20): "N" stands for any nucleotide
agcnnnnnnnnnnnnnnnnnggg

SEQ ID NO: 908 - DNA, 26 bp, Artificial Sequence
  Dyad patterns over-represented in STAR elements
  misc_feature (4)..(23): "N" stands for any nucleotide
cacnnnnnnnnnnnnnnnnnnnnccg

SEQ ID NO: 909 - DNA, 23 bp, Artificial Sequence
  Dyad patterns over-represented in STAR elements
  misc_feature (4)..(20): "N" stands for any nucleotide
acgnnnnnnnnnnnnnnnnncag

SEQ ID NO: 910 - DNA, 7 bp, Artificial Sequence
  Dyad patterns over-represented in STAR elements
  misc_feature (4)..(4): "N" stands for any nucleotide
aggnccc

SEQ ID NO: 911 - DNA, 18 bp, Artificial Sequence
  Dyad patterns over-represented in STAR elements
  misc_feature (4)..(15): "N" stands for any nucleotide
cgtnnnnnnnnnnnncac

SEQ ID NO: 912 - DNA, 15 bp, Artificial Sequence
  Dyad patterns over-represented in STAR elements
  misc_feature (4)..(12): "N" stands for any nucleotide
cggnnnnnnnnnggc

SEQ ID NO: 913 - DNA, 16 bp, Artificial Sequence
  Dyad patterns over-represented in STAR elements
  misc_feature (4)..(13): "N" stands for any nucleotide
cgcnnnnnnnnnngcg

SEQ ID NO: 914 - DNA, 12 bp, Artificial Sequence
  Dyad patterns over-represented in STAR elements
  misc_feature (4)..(9): "N" stands for any nucleotide
cccnnnnnnctc

SEQ ID NO: 915 - DNA, 16 bp, Artificial Sequence
  Dyad patterns over-represented in STAR elements
  misc_feature (4)..(13): "N" stands for any nucleotide
ccgnnnnnnnnnnagg

SEQ ID NO: 916 - DNA, 24 bp, Artificial Sequence
  Dyad patterns over-represented in STAR elements
  misc_feature (4)..(21): "N" stands for any nucleotide
cccnnnnnnnnnnnnnnnnnncag

SEQ ID NO: 917 - DNA, 23 bp, Artificial Sequence
  Dyad patterns over-represented in STAR elements
  misc_feature (4)..(20): "N" stands for any nucleotide
agcnnnnnnnnnnnnnnnnnccg

SEQ ID NO: 918 - DNA, 15 bp, Artificial Sequence
  Dyad patterns over-represented in STAR elements
  misc_feature (4)..(12): "N" stands for any nucleotide
agcnnnnnnnnngcg

SEQ ID NO: 919 - DNA, 9 bp, Artificial Sequence
  Dyad patterns over-represented in STAR elements
  misc_feature (4)..(6): "N" stands for any nucleotide
ccannnggc

SEQ ID NO: 920 - DNA, 17 bp, Artificial Sequence
  Dyad patterns over-represented in STAR elements
  misc_feature (4)..(14): "N" stands for any nucleotide
cccnnnnnnnnnnnggc

SEQ ID NO: 921 - DNA, 11 bp, Artificial Sequence
  Dyad patterns over-represented in STAR elements
  misc_feature (4)..(8): "N" stands for any nucleotide
acgnnnnngca

SEQ ID NO: 922 - DNA, 20 bp, Artificial Sequence
  Dyad patterns over-represented in STAR elements
  misc_feature (4)..(17): "N" stands for any nucleotide
cccnnnnnnnnnnnnnncgg

SEQ ID NO: 923 - DNA, 11 bp, Artificial Sequence
  Dyad patterns over-represented in STAR elements
  misc_feature (4)..(8): "N" stands for any nucleotide
cccnnnnncca

SEQ ID NO: 924 - DNA, 7 bp, Artificial Sequence
  Dyad patterns over-represented in STAR elements
  misc_feature (4)..(4): "N" stands for any nucleotide
ccgnagg

SEQ ID NO: 925 - DNA, 16 bp, Artificial Sequence
  Dyad patterns over-represented in STAR elements
  misc_feature (4)..(13): "N" stands for any nucleotide
gggnnnnnnnnnngac

SEQ ID NO: 926 - DNA, 21 bp, Artificial Sequence
  Dyad patterns over-represented in STAR elements
  misc_feature (4)..(18): "N" stands for any nucleotide
cgcnnnnnnnnnnnnnnncca

SEQ ID NO: 927 - DNA, 25 bp, Artificial Sequence
  Dyad patterns over-represented in STAR elements
  misc_feature (4)..(22): "N" stands for any nucleotide
cctnnnnnnnnnnnnnnnnnnncgc

SEQ ID NO: 928 - DNA, 9 bp, Artificial Sequence
  Dyad patterns over-represented in STAR elements
  misc_feature (4)..(6): "N" stands for any nucleotide
cgtnnncgc

SEQ ID NO: 929 - DNA, 20 bp, Artificial Sequence
  Dyad patterns over-represented in STAR elements
  misc_feature (4)..(17): "N" stands for any nucleotide
agcnnnnnnnnnnnnnnccg

SEQ ID NO: 930 - DNA, 8 bp, Artificial Sequence
  Dyad patterns over-represented in STAR elements
  misc_feature (4)..(5): "N" stands for any nucleotide
ggcnncga

SEQ ID NO: 931 - DNA, 14 bp, Artificial Sequence
  Dyad patterns over-represented in STAR elements
  misc_feature (4)..(11): "N" stands for any nucleotide
cagnnnnnnnnccc

SEQ ID NO: 932 - DNA, 8 bp, Artificial Sequence
  Dyad patterns over-represented in STAR elements
  misc_feature (4)..(5): "N" stands for any nucleotide
ccgnngac

SEQ ID NO: 933 - DNA, 25 bp, Artificial Sequence
  Dyad patterns over-represented in STAR elements
  misc_feature (4)..(22): "N" stands for any nucleotide
agcnnnnnnnnnnnnnnnnnnnagg

SEQ ID NO: 934 - DNA, 10 bp, Artificial Sequence
  Dyad patterns over-represented in STAR elements
  misc_feature (4)..(7): "N" stands for any nucleotide
cctnnnnggc

SEQ ID NO: 935 - DNA, 17 bp, Artificial Sequence
  Dyad patterns over-represented in STAR elements
  misc_feature (4)..(14): "N" stands for any nucleotide
ccgnnnnnnnnnnnagc

SEQ ID NO: 936 - DNA, 10 bp, Artificial Sequence
  Dyad patterns over-represented in STAR elements
  misc_feature (4)..(7): "N" stands for any nucleotide
cacnnnncgc

SEQ ID NO: 937 - DNA, 7 bp, Artificial Sequence
  Dyad patterns over-represented in STAR elements
  misc_feature (4)..(4): "N" stands for any nucleotide
ccgnccc

SEQ ID NO: 938 - DNA, 19 bp, Artificial Sequence
  Dyad patterns over-represented in STAR elements
  misc_feature (4)..(16): "N" stands for any nucleotide
ctgnnnnnnnnnnnnnggc

SEQ ID NO: 939 - DNA, 22 bp, Artificial Sequence
  Dyad patterns over-represented in STAR elements
  misc_feature (4)..(19): "N" stands for any nucleotide
cgcnnnnnnnnnnnnnnnnacc

SEQ ID NO: 940 - DNA, 24 bp, Artificial Sequence
  Dyad patterns over-represented in STAR elements
  misc_feature (4)..(21): "N" stands for any nucleotide
cacnnnnnnnnnnnnnnnnnncag

SEQ ID NO: 941 - DNA, 14 bp, Artificial Sequence
  Dyad patterns over-represented in STAR elements
  misc_feature (4)..(11): "N" stands for any nucleotide
ggcnnnnnnnngcc

SEQ ID NO: 942 - DNA, 21 bp, Artificial Sequence
  Dyad patterns over-represented in STAR elements
  misc_feature (4)..(18): "N" stands for any nucleotide
gggnnnnnnnnnnnnnnngga

SEQ ID NO: 943 - DNA, 22 bp, Artificial Sequence
  Dyad patterns over-represented in STAR elements
  misc_feature (4)..(19): "N" stands for any nucleotide
ccgnnnnnnnnnnnnnnnngcc

SEQ ID NO: 944 - DNA, 26 bp, Artificial Sequence
  Dyad patterns over-represented in STAR elements
  misc_feature (4)..(23): "N" stands for any nucleotide
ccgnnnnnnnnnnnnnnnnnnnnacc

SEQ ID NO: 945 - DNA, 13 bp, Artificial Sequence
  Dyad patterns over-represented in STAR elements
  misc_feature (4)..(10): "N" stands for any nucleotide
cgannnnnnnccc

SEQ ID NO: 946 - DNA, 12 bp, Artificial Sequence
  Dyad patterns over-represented in STAR elements
  misc_feature (4)..(9): "N" stands for any nucleotide
ccgnnnnnnctc

SEQ ID NO: 947 - DNA, 16 bp, Artificial Sequence
  Dyad patterns over-represented in STAR elements
  misc_feature (4)..(13): "N" stands for any nucleotide
cggnnnnnnnnnnctc

SEQ ID NO: 948 - DNA, 22 bp, Artificial Sequence
  Dyad patterns over-represented in STAR elements
  misc_feature (4)..(19): "N" stands for any nucleotide
cagnnnnnnnnnnnnnnnncgc

SEQ ID NO: 949 - DNA, 9 bp, Artificial Sequence
  Dyad patterns over-represented in STAR elements
  misc_feature (4)..(6): "N" stands for any nucleotide
ccannnagg

SEQ ID NO: 950 - DNA, 24 bp, Artificial Sequence
  Dyad patterns over-represented in STAR elements
  misc_feature (4)..(21): "N" stands for any nucleotide
gccnnnnnnnnnnnnnnnnnngcc

SEQ ID NO: 951 - DNA, 24 bp, Artificial Sequence
  Dyad patterns over-represented in STAR elements
  misc_feature (4)..(21): "N" stands for any nucleotide
cgcnnnnnnnnnnnnnnnnnngga

SEQ ID NO: 952 - DNA, 26 bp, Artificial Sequence
  Dyad patterns over-represented in STAR elements
  misc_feature (4)..(23): "N" stands for any nucleotide
ccgnnnnnnnnnnnnnnnnnnnnggc

SEQ ID NO: 953 - DNA, 16 bp, Artificial Sequence
  Dyad patterns over-represented in STAR elements
  misc_feature (4)..(13): "N" stands for any nucleotide
acannnnnnnnnngcg

SEQ ID NO: 954 - DNA, 11 bp, Artificial Sequence
  Dyad patterns over-represented in STAR elements
  misc_feature (4)..(8): "N" stands for any nucleotide
cggnnnnnccc

SEQ ID NO: 955 - DNA, 13 bp, Artificial Sequence
  Dyad patterns over-represented in STAR elements
  misc_feature (4)..(10): "N" stands for any nucleotide
cccnnnnnnntcc

SEQ ID NO: 956 - DNA, 16 bp, Artificial Sequence
  Dyad patterns over-represented in STAR elements
  misc_feature (4)..(13): "N" stands for any nucleotide
acgnnnnnnnnnncgc

SEQ ID NO: 957 - DNA, 9 bp, Artificial Sequence
  Dyad patterns over-represented in STAR elements
  misc_feature (4)..(6): "N" stands for any nucleotide
cccnnntcc

SEQ ID NO: 958 - DNA, 14 bp, Artificial Sequence
  Dyad patterns over-represented in STAR elements
  misc_feature (4)..(11): "N" stands for any nucleotide
ccgnnnnnnnncgg

SEQ ID NO: 959 - DNA, 21 bp, Artificial Sequence
  Dyad patterns over-represented in STAR elements
  misc_feature (4)..(18): "N" stands for any nucleotide
ccannnnnnnnnnnnnnncgg

SEQ ID NO: 960 - DNA, 12 bp, Artificial Sequence
  Dyad patterns over-represented in STAR elements
  misc_feature (4)..(9): "N" stands for any nucleotide
ccgnnnnnnccg

SEQ ID NO: 961 - DNA, 9 bp, Artificial Sequence
  Dyad patterns over-represented in STAR elements
  misc_feature (4)..(6): "N" stands for any nucleotide
cagnnngcg

SEQ ID NO: 962 - DNA, 7 bp, Artificial Sequence
  Dyad patterns over-represented in STAR elements
  misc_feature (4)..(4): "N" stands for any nucleotide
gagnccc

SEQ ID NO: 963 - DNA, 24 bp, Artificial Sequence
  Dyad patterns over-represented in STAR elements
  misc_feature (4)..(21): "N" stands for any nucleotide
ccgnnnnnnnnnnnnnnnnnntgc

SEQ ID NO: 964 - DNA, 13 bp, Artificial Sequence
  Dyad patterns over-represented in STAR elements
  misc_feature (4)..(10): "N" stands for any nucleotide
cccnnnnnnncca

SEQ ID NO: 965 - DNA, 9 bp, Artificial Sequence
  Dyad patterns over-represented in STAR elements
  misc_feature (4)..(6): "N" stands for any nucleotide
cggnnncca

SEQ ID NO: 966 - DNA, 7 bp, Artificial Sequence
  Dyad patterns over-represented in STAR elements
  misc_feature (4)..(4): "N" stands for any nucleotide
acgnccc

SEQ ID NO: 967 - DNA, 19 bp, Artificial Sequence
  Dyad patterns over-represented in STAR elements
  misc_feature (4)..(16): "N" stands for any nucleotide
cggnnnnnnnnnnnnntga

SEQ ID NO: 968 - DNA, 12 bp, Artificial Sequence
  Dyad patterns over-represented in STAR elements
  misc_feature (4)..(9): "N" stands for any nucleotide
ctcnnnnnnggc

SEQ ID NO: 969 - DNA, 8 bp, Artificial Sequence
  Dyad patterns over-represented in STAR elements
  misc_feature (4)..(5): "N" stands for any nucleotide
gcgnngac

SEQ ID NO: 970 - DNA, 17 bp, Artificial Sequence
  Dyad patterns over-represented in STAR elements
  misc_feature (4)..(14): "N" stands for any nucleotide
gggnnnnnnnnnnnacc

SEQ ID NO: 971 - DNA, 10 bp, Artificial Sequence
  Dyad patterns over-represented in STAR elements
  misc_feature (4)..(7): "N" stands for any nucleotide
cgcnnnngga

SEQ ID NO: 972 - DNA, 17 bp, Artificial Sequence
  Dyad patterns over-represented in STAR elements
  misc_feature (4)..(14): "N" stands for any nucleotide
cccnnnnnnnnnnnccg

SEQ ID NO: 973 - DNA, 25 bp, Artificial Sequence
  Dyad patterns over-represented in STAR elements
  misc_feature (4)..(22): "N" stands for any nucleotide
ccgnnnnnnnnnnnnnnnnnnngca

SEQ ID NO: 974 - DNA, 6 bp, Artificial Sequence
  Dyad patterns over-represented in STAR elements
gcggca

SEQ ID NO: 975 - DNA, 13 bp, Artificial Sequence
  Dyad patterns over-represented in STAR elements
  misc_feature (4)..(10): "N" stands for any nucleotide
agannnnnnnccc

SEQ ID NO: 976 - DNA, 8 bp, Artificial Sequence
  Dyad patterns over-represented in STAR elements
  misc_feature (4)..(5): "N" stands for any nucleotide
cggnncca

SEQ ID NO: 977 - DNA, 12 bp, Artificial Sequence
  Dyad patterns over-represented in STAR elements
  misc_feature (4)..(9): "N" stands for any nucleotide
cccnnnnnnccc

SEQ ID NO: 978 - DNA, 10 bp, Artificial Sequence
  Dyad patterns over-represented in STAR elements
  misc_feature (4)..(7): "N" stands for any nucleotide
accnnnngcg

SEQ ID NO: 979 - DNA, 21 bp, Artificial Sequence
  Dyad patterns over-represented in STAR elements
  misc_feature (4)..(18): "N" stands for any nucleotide
cctnnnnnnnnnnnnnnncgc

SEQ ID NO: 980 - DNA, 15 bp, Artificial Sequence
  Dyad patterns over-represented in STAR elements
  misc_feature (4)..(12): "N" stands for any nucleotide
agcnnnnnnnnngtc

SEQ ID NO: 981 - DNA, 24 bp, Artificial Sequence
  Dyad patterns over-represented in STAR elements
  misc_feature (4)..(21): "N" stands for any nucleotide
cccnnnnnnnnnnnnnnnnnnctc

SEQ ID NO: 982 - DNA, 24 bp, Artificial Sequence
  Dyad patterns over-represented in STAR elements
  misc_feature (4)..(21): "N" stands for any nucleotide
cgcnnnnnnnnnnnnnnnnnncga

SEQ ID NO: 983 - DNA, 21 bp, Artificial Sequence
  Dyad patterns over-represented in STAR elements
  misc_feature (4)..(18): "N" stands for any nucleotide
cccnnnnnnnnnnnnnnngcc

SEQ ID NO: 984 - DNA, 17 bp, Artificial Sequence
  Dyad patterns over-represented in STAR elements
  misc_feature (4)..(14): "N" stands for any nucleotide
accnnnnnnnnnnnggc

SEQ ID NO: 985 - DNA, 21 bp, Artificial Sequence
  Dyad patterns over-represented in STAR elements
  misc_feature (4)..(18): "N" stands for any nucleotide
aggnnnnnnnnnnnnnnncgc

SEQ ID NO: 986 - DNA, 6 bp, Artificial Sequence
  Dyad patterns over-represented in STAR elements
gcgcca

SEQ ID NO: 987 - DNA, 15 bp, Artificial Sequence
  Dyad patterns over-represented in STAR elements
  misc_feature (4)..(12): "N" stands for any nucleotide
gcgnnnnnnnnnagc

SEQ ID NO: 988 - DNA, 24 bp, Artificial Sequence
  Dyad patterns over-represented in STAR elements
  misc_feature (4)..(21): "N" stands for any nucleotide
gggnnnnnnnnnnnnnnnnnngca

SEQ ID NO: 989 - DNA, 23 bp, Artificial Sequence
  Dyad patterns over-represented in STAR elements
  misc_feature (4)..(20): "N" stands for any nucleotide
cccnnnnnnnnnnnnnnnnncag

SEQ ID NO: 990 - DNA, 14 bp, Artificial Sequence
  Dyad patterns over-represented in STAR elements
  misc_feature (4)..(11): "N" stands for any nucleotide
ccannnnnnnncgg

SEQ ID NO: 991 - DNA, 16 bp, Artificial Sequence
  Dyad patterns over-represented in STAR elements
  misc_feature (4)..(13): "N" stands for any nucleotide
ccgnnnnnnnnnnggc

SEQ ID NO: 992 - DNA, 6 bp, Artificial Sequence
  Dyad patterns over-represented in STAR elements
gcagcc

SEQ ID NO: 993 - DNA, 8 bp, Artificial Sequence
  Dyad patterns over-represented in STAR elements
  misc_feature (4)..(5): "N" stands for any nucleotide
cagnncgc

SEQ ID NO: 994 - DNA, 14 bp, Artificial Sequence
  Dyad patterns over-represented in STAR elements
  misc_feature (4)..(11): "N" stands for any nucleotide
cgcnnnnnnnnggc

SEQ ID NO: 995 - DNA, 23 bp, Artificial Sequence
  Dyad patterns over-represented in STAR elements
  misc_feature (4)..(20): "N" stands for any nucleotide
ctgnnnnnnnnnnnnnnnnnggc

SEQ ID NO: 996 - DNA, 20 bp, Artificial Sequence
  Dyad patterns over-represented in STAR elements
  misc_feature (4)..(17): "N" stands for any nucleotide
gggnnnnnnnnnnnnnnacc

SEQ ID NO: 997 - DNA, 7 bp, Artificial Sequence
  Dyad patterns over-represented in STAR elements
  misc_feature (4)..(4): "N" stands for any nucleotide
ccgntgc

SEQ ID NO: 998 - DNA, 14 bp, Artificial Sequence
  Dyad patterns over-represented in STAR elements
  misc_feature (4)..(11): "N" stands for any nucleotide
cagnnnnnnnncgc

SEQ ID NO: 999 - DNA, 17 bp, Artificial Sequence
  Dyad patterns over-represented in STAR elements
  misc_feature (4)..(14): "N" stands for any nucleotide
aagnnnnnnnnnnncgc

SEQ ID NO: 1000 - DNA, 12 bp, Artificial Sequence
  Dyad patterns over-represented in STAR elements
  misc_feature (4)..(9): "N" stands for any nucleotide
ccgnnnnnntcc

SEQ ID NO: 1001 - DNA, 24 bp, Artificial Sequence
  Dyad patterns over-represented in STAR elements
  misc_feature (4)..(21): "N" stands for any nucleotide
ccannnnnnnnnnnnnnnnnnccc

SEQ ID NO: 1002 - DNA, 6 bp, Artificial Sequence
  Dyad patterns over-represented in STAR elements
ccaccc

SEQ ID NO: 1003 - DNA, 12 bp, Artificial Sequence
  Dyad patterns over-represented in STAR elements
  misc_feature (4)..(9): "N" stands for any nucleotide
gagnnnnnnccc

SEQ ID NO: 1004 - DNA, 26 bp, Artificial Sequence
  Dyad patterns over-represented in STAR elements
  misc_feature (4)..(23): "N" stands for any nucleotide
agcnnnnnnnnnnnnnnnnnnnnggc

SEQ ID NO: 1005 - DNA, 6 bp, Artificial Sequence
  Dyad patterns over-represented in STAR elements
cagcgc

SEQ ID NO: 1006 - DNA, 18 bp, Artificial Sequence
  Dyad patterns over-represented in STAR elements
  misc_feature (4)..(15): "N" stands for any nucleotide
ccgnnnnnnnnnnnnctc

SEQ ID NO: 1007 - DNA, 21 bp, Artificial Sequence
  Dyad patterns over-represented in STAR elements
  misc_feature (4)..(18): "N" stands for any nucleotide
cgcnnnnnnnnnnnnnnnacg

SEQ ID NO: 1008 - DNA, 23 bp, Artificial Sequence
  Dyad patterns over-represented in STAR elements
  misc_feature (4)..(20): "N" stands for any nucleotide
ggcnnnnnnnnnnnnnnnnncga

SEQ ID NO: 1009 - DNA, 22 bp, Artificial Sequence
  Dyad patterns over-represented in STAR elements
  misc_feature (4)..(19): "N" stands for any nucleotide
ccgnnnnnnnnnnnnnnnnaag

SEQ ID NO: 1010 - DNA, 20 bp, Artificial Sequence
  Dyad patterns over-represented in STAR elements
  misc_feature (4)..(17): "N" stands for any nucleotide
cgcnnnnnnnnnnnnnntcc

SEQ ID NO: 1011 - DNA, 13 bp, Artificial Sequence
  Dyad patterns over-represented in STAR elements
  misc_feature (4)..(10): "N" stands for any nucleotide
aggnnnnnnncgc

SEQ ID NO: 1012 - DNA, 13 bp, Artificial Sequence
  Dyad patterns over-represented in STAR elements
  misc_feature (4)..(10): "N" stands for any nucleotide
cggnnnnnnnccc

SEQ ID NO: 1013 - DNA, 10 bp, Artificial Sequence
  Dyad patterns over-represented in STAR elements
  misc_feature (4)..(7): "N" stands for any nucleotide
cgcnnnngcc

SEQ ID NO: 1014 - DNA, 12 bp, Artificial Sequence
  Dyad patterns over-represented in STAR elements
  misc_feature (4)..(9): "N" stands for any nucleotide
cgannnnnnccc

SEQ ID NO: 1015 - DNA, 25 bp, Artificial Sequence
  Dyad patterns over-represented in STAR elements
  misc_feature (4)..(22): "N" stands for any nucleotide
cccnnnnnnnnnnnnnnnnnnngga

SEQ ID NO: 1016 - DNA, 22 bp, Artificial Sequence
  Dyad patterns over-represented in STAR elements
  misc_feature (4)..(19): "N" stands for any nucleotide
cccnnnnnnnnnnnnnnnngcg

SEQ ID NO: 1017 - DNA, 13 bp, Artificial Sequence
  Dyad patterns over-represented in STAR elements
  misc_feature (4)..(10): "N" stands for any nucleotide
ccannnnnnncgc

SEQ ID NO: 1018 - DNA, 12 bp, Artificial Sequence
  Dyad patterns over-represented in STAR elements
  misc_feature (4)..(9): "N" stands for any nucleotide
cccnnnnnngcc

SEQ ID NO: 1019 - DNA, 20 bp, Artificial Sequence
  Dyad patterns over-represented in STAR elements
  misc_feature (4)..(17): "N" stands for any nucleotide
gccnnnnnnnnnnnnnntcc

SEQ ID NO: 1020 - DNA, 20 bp, Artificial Sequence
  Dyad patterns over-represented in STAR elements
  misc_feature (4)..(17): "N" stands for any nucleotide
aggnnnnnnnnnnnnnngcc

SEQ ID NO: 1021 - DNA, 17 bp, Artificial Sequence
  Dyad patterns over-represented in STAR elements
  misc_feature (4)..(14): "N" stands for any nucleotide
cgcnnnnnnnnnnngcc

SEQ ID NO: 1022 - DNA, 6 bp, Artificial Sequence
  Dyad patterns over-represented in STAR elements
tccgca

SEQ ID NO: 1023 - DNA, 14 bp, Artificial Sequence
  Dyad patterns over-represented in STAR elements
  misc_feature (4)..(11): "N" stands for any nucleotide
gcgnnnnnnnnccc

SEQ ID NO: 1024 - DNA, 17 bp, Artificial Sequence
  Dyad patterns over-represented in STAR elements
  misc_feature (4)..(14): "N" stands for any nucleotide
ccannnnnnnnnnngcg

SEQ ID NO: 1025 - DNA, 10 bp, Artificial Sequence
  Dyad patterns over-represented in STAR elements
  misc_feature (4)..(7): "N" stands for any nucleotide
cacnnnnggg

SEQ ID NO: 1026 - DNA, 13 bp, Artificial Sequence
  Dyad patterns over-represented in STAR elements
  misc_feature (4)..(10): "N" stands for any nucleotide
cggnnnnnnntcc

SEQ ID NO: 1027 - DNA, 11 bp, Artificial Sequence
  Dyad patterns over-represented in STAR elements
  misc_feature (4)..(8): "N" stands for any nucleotide
gcgnnnnngcc

SEQ ID NO: 1028 - DNA, 18 bp, Artificial Sequence
  Dyad patterns over-represented in STAR elements
  misc_feature (4)..(15): "N" stands for any nucleotide
acgnnnnnnnnnnnncag

SEQ ID NO: 1029 - DNA, 25 bp, Artificial Sequence
  Dyad patterns over-represented in STAR elements
  misc_feature (4)..(22): "N" stands for any nucleotide
ccgnnnnnnnnnnnnnnnnnnncgc

SEQ ID NO: 1030 - DNA, 14 bp, Artificial Sequence
  Dyad patterns over-represented in STAR elements
  misc_feature (4)..(11): "N" stands for any nucleotide
cggnnnnnnnntgc

SEQ ID NO: 1031 - DNA, 7 bp, Artificial Sequence
  Dyad patterns over-represented in STAR elements
  misc_feature (4)..(4): "N" stands for any nucleotide
cccngag

SEQ ID NO: 1032 - DNA, 25 bp, Artificial Sequence
  Dyad patterns over-represented in STAR elements
  misc_feature (4)..(22): "N" stands for any nucleotide
gcgnnnnnnnnnnnnnnnnnnntga

SEQ ID NO: 1033 - DNA, 21 bp, Artificial Sequence
  Dyad patterns over-represented in STAR elements
  misc_feature (4)..(18): "N" stands for any nucleotide
ggcnnnnnnnnnnnnnnngcc

SEQ ID NO: 1034 - DNA, 13 bp, Artificial Sequence
  Dyad patterns over-represented in STAR elements
  misc_feature (4)..(10): "N" stands for any nucleotide
ccgnnnnnnnccc

SEQ ID NO: 1035 - DNA, 25 bp, Artificial Sequence
  Dyad patterns over-represented in STAR elements
  misc_feature (4)..(22): "N" stands for any nucleotide
acannnnnnnnnnnnnnnnnnnccc

SEQ ID NO: 1036 - DNA, 22 bp, Artificial Sequence
  Dyad patterns over-represented in STAR elements
  misc_feature (4)..(19): "N" stands for any nucleotide
accnnnnnnnnnnnnnnnnggg

SEQ ID NO: 1037 - DNA, 7 bp, Artificial Sequence
  Dyad patterns over-represented in STAR elements
  misc_feature (4)..(4): "N" stands for any nucleotide
aganggc

SEQ ID NO: 1038 - DNA, 23 bp, Artificial Sequence
  Dyad patterns over-represented in STAR elements
  misc_feature (4)..(20): "N" stands for any nucleotide
gggnnnnnnnnnnnnnnnnntga

SEQ ID NO: 1039 - DNA, 11 bp, Artificial Sequence
  Dyad patterns over-represented in STAR elements
  misc_feature (4)..(8): "N" stands for any nucleotide
cagnnnnnggg

SEQ ID NO: 1040 - DNA, 19 bp, Artificial Sequence
  Dyad patterns over-represented in STAR elements
  misc_feature (4)..(16): "N" stands for any nucleotide
gccnnnnnnnnnnnnncgc

SEQ ID NO: 1041 - DNA, 13 bp, Artificial Sequence
  Dyad patterns over-represented in STAR elements
  misc_feature (4)..(10): "N" stands for any nucleotide
gcgnnnnnnngga

SEQ ID NO: 1042 - DNA, 20 bp, Artificial Sequence
  Dyad patterns over-represented in STAR elements
  misc_feature (4)..(17): "N" stands for any nucleotide
cagnnnnnnnnnnnnnncca

SEQ ID NO: 1043 - DNA, 10 bp, Artificial Sequence
  Dyad patterns over-represented in STAR elements
  misc_feature (4)..(7): "N" stands for any nucleotide
ccgnnnngtc

SEQ ID NO: 1044 - DNA, 19 bp, Artificial Sequence
  Dyad patterns over-represented in STAR elements
  misc_feature (4)..(16): "N" stands for any nucleotide
cccnnnnnnnnnnnnncgc

SEQ ID NO: 1045 - DNA, 20 bp, Artificial Sequence
  Dyad patterns over-represented in STAR elements
  misc_feature (4)..(17): "N" stands for any nucleotide
gcgnnnnnnnnnnnnnnacc

SEQ ID NO: 1046 - DNA, 26 bp, Artificial Sequence
  Dyad patterns over-represented in STAR elements
  misc_feature (4)..(23): "N" stands for any nucleotide
cagnnnnnnnnnnnnnnnnnnnnggg

SEQ ID NO: 1047 - DNA, 10 bp, Artificial Sequence
  Dyad patterns over-represented in STAR elements
  misc_feature (4)..(7): "N" stands for any nucleotide
ccgnnnnccc

SEQ ID NO: 1048 - DNA, 11 bp, Artificial Sequence
  Dyad patterns over-represented in STAR elements
  misc_feature (4)..(8): "N" stands for any nucleotide
cgcnnnnnggc

SEQ ID NO: 1049 - DNA, 12 bp, Artificial Sequence
  Dyad patterns over-represented in STAR elements
  misc_feature (4)..(9): "N" stands for any nucleotide
cctnnnnnnggc

SEQ ID NO: 1050 - DNA, 9 bp, Artificial Sequence
  Dyad patterns over-represented in STAR elements
  misc_feature (4)..(6): "N" stands for any nucleotide
aggnnnggc

SEQ ID NO: 1051 - DNA, 17 bp, Artificial Sequence
  Dyad patterns over-represented in STAR elements
  misc_feature (4)..(14): "N" stands for any nucleotide
cggnnnnnnnnnnncgc

SEQ ID NO: 1052 - DNA, 24 bp, Artificial Sequence
  Dyad patterns over-represented in STAR elements
  misc_feature (4)..(21): "N" stands for any nucleotide
ctgnnnnnnnnnnnnnnnnnngga

SEQ ID NO: 1053 - DNA, 23 bp, Artificial Sequence
  Dyad patterns over-represented in STAR elements
  misc_feature (4)..(20): "N" stands for any nucleotide
cacnnnnnnnnnnnnnnnnncca

SEQ ID NO: 1054 - DNA, 9 bp, Artificial Sequence
  Dyad patterns over-represented in STAR elements
  misc_feature (4)..(6): "N" stands for any nucleotide
cggnnngag

SEQ ID NO: 1055 - DNA, 15 bp, Artificial Sequence
  Dyad patterns over-represented in STAR elements
  misc_feature (4)..(12): "N" stands for any nucleotide
cccnnnnnnnnncca

SEQ ID NO: 1056 - DNA, 7 bp, Artificial Sequence
  Dyad patterns over-represented in STAR elements
  misc_feature (4)..(4): "N" stands for any nucleotide
cccnacg

SEQ ID NO: 1057 - DNA, 7 bp, Artificial Sequence
  Dyad patterns over-represented in STAR elements
  misc_feature (4)..(4): "N" stands for any nucleotide
cagngcc

SEQ ID NO: 1058 - DNA, 12 bp, Artificial Sequence
  Dyad patterns over-represented in STAR elements
  misc_feature (4)..(9): "N" stands for any nucleotide
aggnnnnnnccg

SEQ ID NO: 1059 - DNA, 15 bp, Artificial Sequence
  Dyad patterns over-represented in STAR elements
  misc_feature (4)..(12): "N" stands for any nucleotide
agcnnnnnnnnnggg

SEQ ID NO: 1060 - DNA, 13 bp, Artificial Sequence
  Dyad patterns over-represented in STAR elements
  misc_feature (4)..(10): "N" stands for any nucleotide
cccnnnnnnnggc

SEQ ID NO: 1061 - DNA, 19 bp, Artificial Sequence
  Dyad patterns over-represented in STAR elements
  misc_feature (4)..(16): "N" stands for any nucleotide
cctnnnnnnnnnnnnnccc

SEQ ID NO: 1062 - DNA, 25 bp, Artificial Sequence
  Dyad patterns over-represented in STAR elements
  misc_feature (4)..(22): "N" stands for any nucleotide
ccgnnnnnnnnnnnnnnnnnnnttc

SEQ ID NO: 1063 - DNA, 13 bp, Artificial Sequence
  Dyad patterns over-represented in STAR elements
  misc_feature (4)..(10): "N" stands for any nucleotide
cccnnnnnnnccg

SEQ ID NO: 1064 - DNA, 12 bp, Artificial Sequence
  Dyad patterns over-represented in STAR elements
  misc_feature (4)..(9): "N" stands for any nucleotide
cgannnnnnggc

SEQ ID NO: 1065 - DNA, 10 bp, Artificial Sequence
  Dyad patterns over-represented in STAR elements
  misc_feature (4)..(7): "N" stands for any nucleotide
cggnnnnctc

SEQ ID NO: 1066 - DNA, 6 bp, Artificial Sequence
  Dyad patterns over-represented in STAR elements
cggcgc

SEQ ID NO: 1067 - DNA, 19 bp, Artificial Sequence
  Dyad patterns over-represented in STAR elements
  misc_feature (4)..(16): "N" stands for any nucleotide
cctnnnnnnnnnnnnnacg

SEQ ID NO: 1068 - DNA, 12 bp, Artificial Sequence
  Dyad patterns over-represented in STAR elements
  misc_feature (4)..(9): "N" stands for any nucleotide
gggnnnnnncac

SEQ ID NO: 1069 - DNA, 22 bp, Artificial Sequence
  Dyad patterns over-represented in STAR elements
  misc_feature (4)..(19): "N" stands for any nucleotide
cccnnnnnnnnnnnnnnnncgc

SEQ ID NO: 1070 - DNA, 16 bp, Artificial Sequence
  Dyad patterns over-represented in STAR elements
  misc_feature (4)..(13): "N" stands for any nucleotide
cccnnnnnnnnnnctc

SEQ ID NO: 1071 - DNA, 6 bp, Artificial Sequence
  Dyad patterns over-represented in STAR elements
ccccag

SEQ ID NO: 1072 - DNA, 11 bp, Artificial Sequence
  Dyad patterns over-represented in STAR elements
  misc_feature (4)..(8): "N" stands for any nucleotide
gccnnnnnccc

What is claimed is:

1. A method for producing a proteinaceous molecule in a cell comprising:
    providing a cell selected from the group consisting of a cell having an adenovirus Early Region 1 (E1) sequence, a HuNS-1 myeloma cell, a 293 cell, a CHO cell, a Vero cell, a WERI-Rb-1 retinoblastoma cell, a BHK cell, a non-secreting mouse myeloma Sp2/0-Ag 14 cell, a non-secreting mouse myeloma NSO cell, and an NCI-H295R adrenal gland carcinoma cell;
    wherein said cell comprises an anti-repressor activity sequence operably linked to a nucleic acid sequence encoding a proteinaceous molecule of interest, wherein said anti-repressor activity sequence comprises SEQ ID NO:7;
    expressing the proteinaceous molecule in said cell; and
    isolating said proteinaceous molecule.

2. The method of claim 1, wherein said cell comprises an adenovirus Early Region 1 (E1) sequence.

3. The method of claim 1, wherein said proteinaceous molecule is secreted by said cell.

4. The method according to claim 1, wherein said cell comprises a plurality of the anti-repressor activity sequence operably linked to said nucleic acid sequence encoding the proteinaceous molecule.

5. The method according to claim 4, wherein at least one anti-repressor activity sequence is positioned 5' of the sequence encoding the proteinaceous molecule and at least one anti-repressor activity sequence is positioned 3' of the sequence encoding the proteinaceous molecule.

6. A recombinant host cell line, comprising:
    a cell selected from the group consisting of a cell line comprising an adenovirus Early Region 1 (E1) sequence, a HuNS-1 myeloma cell line, a 293 cell line, a CHO cell line, a Vero cell line, a WERI-Rb-1 retinoblastoma cell line, a BHK cell line, a non-secreting mouse myeloma Sp2/0-Ag 14 cell line, a non-secreting mouse myeloma NSO cell line, and an NCI-H295R adrenal gland carcinoma cell line;

said cell comprising an anti-repressor activity sequence operably linked to a nucleic acid sequence encoding a proteinaceous molecule of interest, wherein said anti-repressor activity sequence comprises SEQ ID NO:7.

7. The recombinant host cell line of claim 6, wherein said cell line comprises an adenovirus Early Region 1 sequence.

8. The recombinant host cell line of claim 6, wherein said cell comprises a plurality of the anti-repressor activity sequence operably linked to said nucleic acid sequence encoding the proteinaceous molecule.

9. The recombinant host_cell line of claim 8, wherein at least one anti-repressor activity sequence is positioned 5' of the sequence encoding the proteinaceous molecule and at least one anti-repressor activity sequence is positioned 3' of the sequence encoding the proteinaceous molecule.

10. The method according to claim 1, wherein said anti-repressor activity sequence is SEQ ID NO:7.

11. The recombinant host cell line of claim 6, wherein said anti-repressor activity sequence is SEQ ID NO:7.

* * * * *